(12) United States Patent
Anthony et al.

(10) Patent No.: US 9,422,581 B2
(45) Date of Patent: *Aug. 23, 2016

(54) HOST CELLS AND METHODS FOR PRODUCTION OF ISOBUTANOL

(71) Applicant: BUTAMAX(TM) ADVANCED BIOFUELS LLC, Wilmington, DE (US)

(72) Inventors: Larry Cameron Anthony, Aston, PA (US); Hongxian He, Wilmington, DE (US); Lixuan Lisa Huang, Hockessin, DE (US); Daniel P. Okeefe, Ridley Park, PA (US); Arthur Leo Kruckeberg, Wilmington, DE (US); Yougen Li, Pennington, NJ (US); Lori Ann Maggio-Hall, Wilmington, DE (US); Jessica McElvain, Wilmington, DE (US); Mark J. Nelson, Newark, DE (US); Ranjan Patnaik, Newark, DE (US); Steven Cary Rothman, Wilmington, DE (US)

(73) Assignee: Butamax Advanced Biofuels LLC, Wilmington, DE (US)

(*) Notice: Subject to any disclaimer, the term of this patent is extended or adjusted under 35 U.S.C. 154(b) by 0 days.

This patent is subject to a terminal disclaimer.

(21) Appl. No.: 13/840,649

(22) Filed: Mar. 15, 2013

(65) Prior Publication Data

US 2014/0030782 A1    Jan. 30, 2014

Related U.S. Application Data

(63) Continuation of application No. 13/428,585, filed on Mar. 23, 2012.

(60) Provisional application No. 61/472,484, filed on Apr. 6, 2011, provisional application No. 61/467,261, filed on Mar. 24, 2011, provisional application No. 61/472,487, filed on Apr. 6, 2011, provisional application No. 61/467,271, filed on Mar. 24, 2011, provisional application No. 61/570,513, filed on Dec. 14, 2011, provisional application No. 61/467,249, filed on Mar. 24, 2011, provisional application No. 61/472,497, filed on Apr. 6, 2011, provisional application No. 61/472,474, filed on Apr. 6, 2011.

(51) Int. Cl.
  *C12P 7/16* (2006.01)
  *C12N 15/81* (2006.01)
  *C12N 9/04* (2006.01)
  *C12P 7/42* (2006.01)
  *C12N 1/38* (2006.01)

(52) U.S. Cl.
  CPC ... *C12P 7/16* (2013.01); *C12N 1/38* (2013.01); *C12N 9/0006* (2013.01); *C12N 15/81* (2013.01); *C12N 15/815* (2013.01); *C12P 7/42* (2013.01); *Y02E 50/10* (2013.01); *Y02P 20/52* (2015.11)

(58) Field of Classification Search
  CPC ............. C12P 7/42; C12P 7/16; C12N 15/81; C12Y 101/01086
  USPC ......................................................... 435/160
  See application file for complete search history.

(56) References Cited

U.S. PATENT DOCUMENTS

| | | |
|---|---|---|
| 4,683,202 A | 7/1987 | Mullis et al. |
| 4,865,973 A | 9/1989 | Kollerup et al. |
| 5,643,779 A | 7/1997 | Erlich et al. |
| 6,586,229 B1 | 7/2003 | Ben-Bassat et al. |
| 6,960,465 B1 | 11/2005 | Papoutsakis et al. |
| 7,541,173 B2 | 6/2009 | Bramucci et al. |
| 7,659,104 B2 | 2/2010 | Bramucci et al. |
| 7,851,188 B2 | 12/2010 | Donaldson et al. |
| 7,910,342 B2 | 3/2011 | Liao et al. |
| 7,993,889 B1 | 8/2011 | Donaldson et al. |
| 8,017,364 B2 | 9/2011 | Bramucci et al. |
| 8,017,376 B2 | 9/2011 | Dundon et al. |
| 8,043,638 B2 | 10/2011 | Omura |
| 8,071,358 B1 * | 12/2011 | Dundon et al. ............ 435/254.2 |
| 8,097,440 B1 | 1/2012 | Buelter et al. |
| 8,101,808 B2 | 1/2012 | Evanko et al. |
| 8,129,162 B2 | 3/2012 | Li et al. |
| 8,133,715 B2 | 3/2012 | Buelter et al. |
| 8,153,415 B2 | 4/2012 | Buelter et al. |
| 8,158,404 B2 | 4/2012 | Lies et al. |
| 8,178,328 B2 | 5/2012 | Donaldson et al. |

(Continued)

FOREIGN PATENT DOCUMENTS

| | | |
|---|---|---|
| WO | WO9408020 | 4/1994 |
| WO | 0061722 A1 | 10/2000 |

(Continued)

OTHER PUBLICATIONS

Davison BH et al. Continuous Direct Solvent Extration of Butanol in a Fermenting Fluidized-Bed Bioreactor with Immobilized Clostridium acetobutylicum. 1993. Applied Biochemistry and Biotechnology. vol. 39/40. p. 415-426.*

Kumenovics A et al. Identification of FRA1 and FRA2 as genes involved in regulating the yeast iron regulon in response to decreased mitochondrial iron-sulfur cluster synthesis. 2008. Journal of Biological Chemistry. 283:10276-10286.*

GenBank EDR97797.1. Feb. 12, 2008. 1 page.*

(Continued)

*Primary Examiner* — Paul Holland

(57) ABSTRACT

Provided herein are recombinant yeast host cells and methods for their use for production of isobutanol. Yeast host cells provided comprise an isobutanol biosynthetic pathway and at least one of reduced or eliminated aldehyde dehydrogenase activity, reduced or eliminated acetolactate reductase activity; or a heterologous polynucleotide encoding a polypeptide having ketol-acid reductoisomerase activity.

10 Claims, 34 Drawing Sheets

(56) References Cited

U.S. PATENT DOCUMENTS

| | | | |
|---|---|---|---|
| 8,188,250 B2 | 5/2012 | Bramucci et al. |
| 8,206,970 B2 | 6/2012 | Eliot et al. |
| 8,222,017 B2 | 7/2012 | Li et al. |
| 8,232,089 B2 | 7/2012 | Urano et al. |
| 8,241,878 B2 | 8/2012 | Anthony et al. |
| 8,273,558 B2 | 9/2012 | Donaldson et al. |
| 8,273,565 B2 | 9/2012 | Dundon et al. |
| 8,283,144 B2 | 10/2012 | Donaldson et al. |
| 8,372,612 B2 | 2/2013 | Larossa et al. |
| 8,389,252 B2 | 3/2013 | Larossa |
| 8,455,224 B2 | 6/2013 | Paul |
| 8,455,225 B2 | 6/2013 | Bramucci et al. |
| 8,455,239 B2 | 6/2013 | Feldman et al. |
| 8,465,964 B2 | 6/2013 | Anthony |
| 8,518,678 B2 | 8/2013 | Flint et al. |
| 8,557,562 B2 | 10/2013 | Bramucci et al. |
| 8,614,085 B2 | 12/2013 | Van Dyk |
| 8,637,281 B2 | 1/2014 | Paul et al. |
| 8,637,289 B2 | 1/2014 | Anthony et al. |
| 8,652,823 B2 | 2/2014 | Flint et al. |
| 8,669,094 B2 | 3/2014 | Anthony et al. |
| 8,691,540 B2 | 4/2014 | Bramucci et al. |
| 8,735,114 B2 | 5/2014 | Donaldson et al. |
| 8,765,433 B2 | 7/2014 | Gude et al. |
| 8,785,166 B2 | 7/2014 | Anthony |
| 8,795,992 B2 | 8/2014 | Bramucci et al. |
| 8,828,694 B2 | 9/2014 | Anthony et al. |
| 8,828,704 B2 | 9/2014 | Donaldson et al. |
| 8,871,488 B2 | 10/2014 | Dauner et al. |
| 8,889,385 B2 | 11/2014 | Donaldson et al. |
| 8,895,307 B2 | 11/2014 | Li et al. |
| 8,906,666 B2 | 12/2014 | Alsaker et al. |
| 8,911,981 B2 | 12/2014 | Li et al. |
| 8,940,511 B2 | 1/2015 | Larossa |
| 8,945,859 B2 | 2/2015 | Donaldson et al. |
| 8,945,899 B2 | 2/2015 | Li et al. |
| 8,951,774 B2 | 2/2015 | Donaldson et al. |
| 8,951,937 B2 | 2/2015 | Flint et al. |
| 8,956,850 B2 | 2/2015 | Anthony |
| 8,962,298 B2 | 2/2015 | Donaldson et al. |
| 8,969,065 B2 | 3/2015 | Anthony et al. |
| 8,980,612 B2 | 3/2015 | Donaldson et al. |
| 2002/0061569 A1 | 5/2002 | Haselbeck et al. |
| 2004/0234649 A1 | 11/2004 | Lewis et al. |
| 2004/0248250 A1 | 12/2004 | Nakai et al. |
| 2005/0059136 A1 | 3/2005 | van Maris et al. |
| 2005/0112739 A1 | 5/2005 | Golubkov |
| 2007/0031918 A1 | 2/2007 | Dunson, Jr. et al. |
| 2007/0031950 A1 | 2/2007 | Winkler |
| 2007/0092957 A1 | 4/2007 | Donaldson et al. |
| 2007/0259411 A1 | 11/2007 | Bramucci et al. |
| 2008/0182308 A1 | 7/2008 | Donaldson et al. |
| 2008/0261230 A1 | 10/2008 | Liao et al. |
| 2008/0261861 A1 | 10/2008 | Sleep et al. |
| 2009/0081746 A1 | 3/2009 | Liao et al. |
| 2009/0163376 A1* | 6/2009 | Li et al. ............... 506/9 |
| 2009/0269823 A1 | 10/2009 | Bramucci et al. |
| 2009/0305363 A1 | 12/2009 | Anthony et al. |
| 2010/0081154 A1 | 4/2010 | Flint et al. |
| 2010/0081173 A1 | 4/2010 | Park et al. |
| 2010/0081179 A1 | 4/2010 | Anthony et al. |
| 2010/0081182 A1 | 4/2010 | Paul et al. |
| 2010/0081183 A1 | 4/2010 | Paul et al. |
| 2010/0093020 A1 | 4/2010 | Bramucci et al. |
| 2010/0112655 A1 | 5/2010 | Paul et al. |
| 2010/0120105 A1 | 5/2010 | Anthony et al. |
| 2010/0124773 A1 | 5/2010 | Yang et al. |
| 2010/0129887 A1 | 5/2010 | Anthony et al. |
| 2010/0143997 A1 | 6/2010 | Buelter et al. |
| 2010/0197519 A1 | 8/2010 | Li et al. |
| 2011/0076733 A1* | 3/2011 | Urano et al. ............ 435/160 |
| 2011/0111472 A1 | 5/2011 | Donaldson et al. |
| 2011/0124060 A1 | 5/2011 | Anthony et al. |
| 2011/0136192 A1 | 6/2011 | Paul et al. |
| 2011/0195505 A1 | 8/2011 | Euler et al. |
| 2011/0201072 A1 | 8/2011 | Bastian et al. |
| 2011/0244536 A1 | 10/2011 | Nagarajan et al. |
| 2011/0250610 A1 | 10/2011 | Bramucci et al. |
| 2011/0275129 A1* | 11/2011 | Buelter et al. ............ 435/160 |
| 2012/0058541 A1 | 3/2012 | Alsaker et al. |
| 2012/0064561 A1 | 3/2012 | Flint et al. |
| 2012/0149080 A1 | 6/2012 | Bramucci et al. |
| 2012/0196341 A1 | 8/2012 | Donaldson et al. |
| 2012/0237988 A1 | 9/2012 | Anthony et al. |
| 2012/0258873 A1 | 10/2012 | Gibson et al. |
| 2013/0035515 A1 | 2/2013 | Dobson et al. |
| 2013/0071898 A1 | 3/2013 | Anthony et al. |
| 2013/0171706 A1 | 7/2013 | Donaldson et al. |
| 2013/0203138 A1 | 8/2013 | McElvain |
| 2013/0252296 A1 | 9/2013 | Maggio-Hall |
| 2013/0316414 A1 | 11/2013 | Paul |
| 2013/0344551 A1 | 12/2013 | Li et al. |
| 2014/0004526 A1 | 1/2014 | Dauner et al. |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0038268 A1 | 2/2014 | Flint et al. |
| 2014/0051133 A1 | 2/2014 | Govindarajan et al. |
| 2014/0051137 A1 | 2/2014 | Flint et al. |
| 2014/0057329 A1 | 2/2014 | Li et al. |
| 2014/0093930 A1 | 4/2014 | Li et al. |
| 2014/0096439 A1 | 4/2014 | Bramucci et al. |
| 2014/0141479 A1 | 5/2014 | Anthony et al. |
| 2014/0170732 A1 | 6/2014 | Bramucci et al. |
| 2014/0186910 A1 | 7/2014 | Rothman et al. |
| 2014/0186911 A1 | 7/2014 | Anthony et al. |
| 2014/0273116 A1 | 9/2014 | Kelly et al. |
| 2014/0273129 A1 | 9/2014 | Bhalla et al. |
| 2014/0308735 A1 | 10/2014 | Anthony |
| 2014/0335582 A1 | 11/2014 | Donaldson et al. |
| 2014/0349349 A1 | 11/2014 | Dauner et al. |
| 2014/0377824 A1 | 12/2014 | Satagopan et al. |
| 2015/0037855 A1 | 2/2015 | Bhadra et al. |
| 2015/0111269 A1 | 4/2015 | Li et al. |
| 2015/0119608 A1 | 4/2015 | Donaldson et al. |
| 2015/0125920 A1 | 5/2015 | Anthony et al. |

FOREIGN PATENT DOCUMENTS

| | | |
|---|---|---|
| WO | WO0112833 | 2/2001 |
| WO | WO2005040392 | 5/2005 |
| WO | WO2008098227 | 8/2008 |
| WO | WO2008130995 | 10/2008 |
| WO | WO2009056984 | 5/2009 |
| WO | WO2009059253 | 5/2009 |
| WO | WO2009078108 | 6/2009 |
| WO | WO 2009078108 A1 * | 6/2009 |
| WO | WO2009086423 | 7/2009 |
| WO | WO 2010051527 A2 * | 5/2010 |
| WO | WO2010062597 | 6/2010 |
| WO | WO2011019894 | 2/2011 |
| WO | 2012027642 A1 | 3/2012 |

OTHER PUBLICATIONS

Abbad-Andaloussi et al., Carbon and Electron Flow in Clostridium butyricum grown in Chemostat Culture on Glycerol and on Glucose, Microbiology 142:1149-1149-1158, 1996.

Arthur et al., Contribution of VanY D,D-Carboxypeptidase to Glycopeptide Resistance in Enterococcus faecalis by Hydrolysis of Peptidoglycan Precursors, Antimicrob. Agents Chemother. 38:1899-1903, 1994.

Aulabaugh, et al., Oxalyl Hydroxamates as Reaction-Intermediate Analogues for Ketol-Acid Reductoisomerase, Biochemistry 29:2824-2830 1990.

Biou, et al. The crystal structure of plant acetohydroxy acid isomeroreductase complexed with NADPH, two magnesium ions and a herbicidal transition state analog determined at 1.65 Å resolution, EMBO Journal 16:3405-3415, 1997.

van der Geize et al., Targeted Disruption of the kstD Gene Encoding a 3-Ketosteroid delta1-Dehydrogenase Isoenzyme of Rhodococcus erythropolis Strain SQ1, Appl. Environ. Microbiol. 66:2029-2036, 2000.

(56) References Cited

OTHER PUBLICATIONS

Chunduru, et al., Mechanism of Ketol Acid Reductoisomerase—Steady State Analysis and Metal Ion Requirement, Biochemistry 28:486-493 1989.

de Cavalho, et al., *Mycobacterium* sp., Rhodococcus erythropolis, and Pseudomonas putida Behavior in the Presence of Organic Solvents, Microsc. Res. Tech. 64:215-22, 2004.

de la Plaza, et al., Biochemical and molecular characterization of alpha-ketoisovalerate decarboxylase, an enzyme involved in the formation of aldehydes from amino acids by *Lactococcus lactis*, FEMS Microbiol. Lett. 238:367-374, 2004.

Deshpande, Ethanol Production from Cellulose by Coupled Saccharification/Fermentation using *Saccharomyces cerevisiae* and Cellulase Complex from Sclerotium rolfsii UV-8 Mutant, Appl. Biochem. Biotechnol. 36:227, 1992.

Dürre, et al., Solventogenic Enzymes of Clostridium acetobutylicum: Catalytic Properties, Genetic Organization, and Transcriptional Regulation, FEMS Microbiol. Rev. 17:251-262, 1995.

Dürre, New insights and novel developments in clostridial acetone/butanol/isopropanol fermentationAppl. Microbiol. Biotechnol. 49:639-648, 1998.

Eichenbaum et al., Use of the Lactococcal nisA Pomoer To Regulae Gene Expession in Gram-Positive Bacteria: Comparison of Induction Level and Promoter Strength, Appl. Environ. Microbiol. 64:2763-2769, 1998.

Fleming, et al., Extracellular Enzyme Synthesis in a Sporulation-Deficient Strain of Bacillus licheniformis, Appl. Environ. Microbiol. 61:3775-3780, 1995.

Flint, et al., The Role and Properties of the Iron-Sulfur Cluster in *Escherichia coli* Dihydroxy-acid Dehydratase, J. Biol. Chem. 268:14732-14742, 1993.

Ford, et al., Characterization of Yprlp from *Saccharomyces cerevisiae* as a 2-methylbutyraldehyde reductase, Yeast 19:1087-1096, 2002.

Fujimoto, et al., pAM401-Based Shuttle Vectors That Enable Overexpression of Promoterless Genes and One-Step Purification of Tag Fusion Proteins Directly from Enterococcus faecalis, Appl. Environ. Microbiol. 67:1262-1267, 2001.

Gollop, et al., Physiological Implications of the Substrate Specificities of Acetohydroxy Acid Synthases from Varied Organisms, J. Bacteriol. 172:3444-3449, 1990.

Groot, et al., Technologies for Butanol Recovery Integrated with Fermentations, Process. Biochem. 27:61-75, 1992.

Guex, et al., SWISS-MODEL and the Swiss-PdbViewer: An Environment for Comparative Protein Modeling, Electrophoresis 18:2714-2723, 1997.

Hermann, et al., Isolation and Characterization of Butanol-Resistant Mutants of Clostridium acetobutylicum, Appl. Environ. Microbiol. 50:1238-1243, 1985.

Holtzclaw, et al., Degradative Acetolactate Synthase of Bacillus subtilis: Purification and Properties, J. Bacteriol. 121:917-922, 1975.

Jones, et al., Improved Methods for Building Protein Models in Electron Density Maps and the Location of Errors in these Models, Acta Crystallogr. A 47:110-119, 1991.

Kabelitz et al., Effect of aliphatic alcohols on growth and degree of saturation of membrane lipids in Acinetobacter calcoaceticus, FEMS Microbiol. Lett. 220: 223-227, 2003.

Datsenko, et al., One-step inactivation of chromosomal genes in *Escherichia coli* K-12 using PCR products, Proc. Natl. Acad. Sci. USA 97:6640-6645, 2000.

Kleerebezem, et al., Controlled Gene Expression Systems for Lactic Acid Bacteria: Transferable Nisin-Inducible Expression Cassettes for *Lactococcus, Leuconostoc,* and *Lactobacillus* spp., Appl. Environ. Microbiol. 63:4581-4584, 1997.

Kostichka, et al., A small cryptic plasmid from Rhodococcus erythropolis : characterization and utility for gene expressionAppl. Microbiol. Biotechnol. 62:61-68, 2003.

Krogh, et al., Hidden Markov Models in Computational Biology, J. Mol. Biol. 235:1501-1531, 1994.

Larroy, et al., Characterization of the *Saccharomyces cerevisiae* YMR318C (ADH6) gene product as a broad specificity NADPH-dependent alcohol dehydrogenase: relevance in aldehyde reduction, Biochem. J. 361:163-172, 2002.

Maguin, et al., New Termosensitive Plasmid for Gram-Positive Bacteria, J. Bacteriol. 174:5633-5638, 1992.

Marinus, et al., Regulation of Isoleucine-Valine Biosynthesis in Pseudomonas aeruginosa, Genetics 63:547-56, 1969.

Nagarajan, et al., Modular Expression and Secretion Vectors for Bacillus subtilis, Gene 114:121-126, 1992.

Nakashima et al., Isolation and Characterization of a Rolling-Circle-Type Plasmid from Rhodococcus erythropolis and Application of the Plasmid to Multiple-Recombinant-Protein Expression, Appl. Environ. Microbiol. 70:5557-5568, 2004.

Nallaapareddy, et al., Construction of Improved Temperature-Sensitive and Mobilizable Vectors and Their Use for Constructing Mutations in the Adhesin-Encoding acm Gene of Poorly Transformable Clinical Enterococcus faecium Strains, Appl. Environ. Microbiol. 72:334-345, 2006.

O'Sullivan, et al., High- and low-copy-number Lactococcus shuttle cloning vectors with features for clone screening, Gene 137:227-231, 1993.

Payne, et al., Use of Alkaline Phosphatase Fusions to Study Protein Secretion in Bacillus subtilis, J. Bacteriol. 173:2278-2282, 1991.

Renault, et al., Plasmid Vectors for Gram-positive Bacteria Swithching from High to Low Copy Number, Gene 183:175-182, 1996.

Scott, et al., Sequences of versatile broad-host-range vectors of the RK2 family, Plasmid 50:74-79, 2003.

Smit, et al., Identification, Cloning, and Characterization of a Lactococcus lactis Branched-Chain alpha-Keto Acid Decarboxylase Involved in Flavor Formation, Appl. Environ. Microbiol. 71:303-311, 2005.

Sulter et al., Proliferation and metabolic significance of peroxisomes in Candida boidinii during drowth on D-alanine or oleic acid as the sole carbon source, Arch. Microbiol. 153:485 489, 1990.

Sulzenbacher, et al., Crystal Structure of *E. coli* Alcohol Dehydrogenase YqhD: Evidence of a Covalently Modified NADP Coenzyme, J. Mol. Biol. 342:489-502, 2004.

Tabor, et al., A baceriophage T7 RNA polymerase/promoter system for controlled exclusive expression of specific genes, Proc. Acad. Sci. USA 82:1074, 1985.

Taghavi, et al., Electroporation of Alcaligenes eutrophus with (Mega) Plasmids and Genomic DNA Fragments, Appl. Environ. Microbiol. 60:3585-3591, 1994.

Tanimoto, et al., Analysis of the Conjugal Transfer System of the Pheromone-Independent Highly Transferable Enterococcus Plasmid pMG1: Identification of a tra Gene (traA) Up-Regulated during Conjugation, J. Bacteriol. 184:5800-5804, 2002.

Tao, et al., Construction of highly efficient *E. coli* expression systems containing low oxygen induced promoter and partition region, Appl. Microbiol. Biotechnol. 68:346-354, 2005.

Thompson, et al., Clustal W: improving the sensitivity of progressive multiple sequence alignment through sequence weighting, position-specific gap penalties and weight matrix choice, Nuc. Acid Res. 22:4673-4680, 1994.

Tomas, et al., Transcriptional Analysis of Butanol Stress and Tolerance in *Clostridium acetobutylicum*, J. Bacteriol. 186:2006-2018, 2004.

Tyagi, et al., The crystal structure of a bacterial Class II ketol-acid reductoisomerase: Domain conservation and evolution, Protein Sci. 14:3089-3100, 2005.

van Kranenburg, et al., Functional Analysis of Three Plasmids from Lactobacillus plantarum, Appl. Environ. Microbiol. 71:1223-1230, 2005.

Walker, et al., Isothermal in vitro amplification of DNA by a restriction enzyme/DNA polymerase systemProc. Natl. Acad. Sci. U.S.A. 89:392-396, 1992.

Wyckoff, et al., Characterization and Sequence Analysis of a Stable Cryptic Plasmid from Enterococcus faecium 226 and Development of a Stable Cloning Vector, Appl. Environ. Microbiol. 62:1481-1486, 1996.

(56) References Cited

OTHER PUBLICATIONS

Dumas, et al., Purification and characterization of a fusion protein of plant acetohydroxy acid synthase and acetohydroxy acid isomeroreductase, FEBS Lett. 408:156-160, 1997.
Bellion et al., Microb. Growth C1 Compd., [Int. Symp.], 7th (1993), 415 32. (eds): Murrell, J. Collin; Kelly, Don P. Publisher: Intercept, Andover, UK.
Dumas, et al., Isolation and kinetic properties of acetohydroxy acid isomeroreductase from spinach (*Spinacia oleracea*) chloroplasts overexpressed in *Escherichia coli*, Biochem. J. 288:865-874, 1992.
Epelbaum, et al. Branched-chain amino acid biosynthesis in *Salmonella typhimurium*: a quantitative analysis, J. Bacteriol. 180:4056-4067, 1998.
Kuzuyama, Mevalonate and nonmevalonate pathways for the biosynthese of isoprene units, Biosci. Biotechnol. Biochem. 66:1619-1627, 2002.
Garcia, et al. Fusel alcohols production in beer fermentation processes, Proc. Biochem. 29:303-309,1994.
Carlini, et al., Guerbet condensation of methanol with n-propanol to isobutyl alcohol over heterogeneous copper chromite/Mg-Al mixed oxides, J. Mol. Catalysis A 220:215-220, 2004.
Rothstein, Targeting, disruption, replacement, and allele rescue: integrative DNA transformation in yeast, Meth. Enzymol. 194:281-301, 1991.
Horton, et al., Engineering hybrid genes without the use of restriction enzymes: gene splicing by overlap extension, Gene 77:61-68, 1989.
Kaneko, et al., Complete Genome Sequence of the Filamentous Nitrogen-fixing *Cyanobacterium anabaena* sp. strain PCC 7120, DNA Res. 8:205-213, 227-253, 2001.
Dickinson, et al., An Investigation of the Metabolism to Isobutyl Alcohol in *Saccharomyces cerevisiae*, J. Biol. Chem. 273:25752-25756, 1998.
Oaxaca, et al., Formation of Ethanol and Higher Alcohols by Immobilized Zymomonas mobilis in Continuous Culture, Acta Biotechnol. 11:523-532, 1991.
Eppink, et al., Switch of Coenzyme Specificity of p-Hydroxybenzoate Hydroxylase, J. Mol. Biol. 292:87-96, 1999.
Nakanishi, et al., Switch of Coenzyme Specificity of Mouse Lung Carbonyl Reductase by Substitution of Threonine 38 with Aspartic Acid, J. Biol. Chem. 272:2218-2222, 1997.
Kamerbeek, et al., Identifying Determinants of NADPH Specificity in Baeyer-Villiger Monooxygenases, Eur. J. Biochem. 271:2107-2116, 2004.
Nishiyama, et al., Alteration of Coenzyme Specificity of Malate Dehydrogenase from Thermus flavus by Site-directed Mutagenesis, J. Biol. Chem. 268:4656-4660, 1993.
Martinez-Julvez, et al., Towards a New Interaction Enzyme: Coenzyme, Biophys. Chem. 115:219-224, 2005.
Rane, et al., Reversal of the Nucleotide Specificity of Ketol Acid Reductoisomerase by Site-Directed Mutagenesis Identifies the NADPH Binding Site, Archiv. Biochem. Biophys. 338:83-89, 1997.
Ahn, et al., Crystal Structure of Class I Acetohydroxy Acid Isomeroreductase from *Pseudomonas aeruginosa*, J. Mol. Biol. 328:505-515, 2003.
Paulsen, et al., Complete genome sequence of the plant commensal Pseudomonas fluorescens Pf-5, Nature Biotechnol. 23:8730878, 2005.
Carugo, et al., NADP-Dependent Enzymes I: Conserved Stereochemistry of Cofactor Binding, Proteins: Structure, Function, and Genetics 28:10-28, 1997.
Dumas, et al., Enzymology, Structure, and Dynamics of Acetohydroxy Acid Isomeroreductase, Acc. Chem. Res. 34:399-408, 2001.
Elmore, et al., Modification of the Nucleotide Cofactor-binding Site of Cytochrome P-450 Reductase to Enhance Turnover with NADH in vivo, J. Biol. Chem. 277:48960-48964, 2002.
Fisher, et al., The X-ray Structure of Brassica napus beta-keto acyl carrier protein reductase and its implication for substrate binding and catalysis, Structure 8:339-347, 2000.

Khoury, et al., Computational design of Candida boidinii xylose reductase for altered cofactor specificity, Protein Sci. 18:2125-2136, 2009.
Kuzuyama, et al., Characterization of 1-deoxy-D-xylulose 5-Phosphate Reductoisomerase, an Enzyme Involved in Isopentenyl Diphosphate Biosynthesis, and Identification of Its Catalytic Amino Acid Residues, J. Biol. Chem. 275:19928-19932, 2000.
Medina, et al., Probing the Determinants of Coenzyme Specificity in Ferredoxin-NADP+ Reductase by Site-directed Mutagenesis, J. Biol. Chem. 276:11902-11912, 2001.
Wierenga, et al., Prediction of the Occurence of the SDP-binding Beta-alpha-beta Fold in Proteins, Using an Amino Acid Sequence Fingerprint, J. Mol. Biol. 187:101-107, 1986.
Brinkmann-Chen, et al., General approach to reversing ketol-acid reductoisomerase cofactor dependence from NADPH to NADPH, Proc. Natl. Acad. Sci. 110:10946-10951, 2013.
Rossmann, et al., Chemical and biological evolution of nucleotide-binding protein, Nature 250:194-199, 1974.
Curien, et al., Nucleotide sequence and characterization of a cDNA encoding the acetohydroxy acid isomeroreductase from *Arabidopsis thaliana*, Plant Molecular Biology 21:717-722, 1993.
Dumas, et al., Purification and characterization of acetohydroxyacid reductoisomerase from spinach chloroplasts, Biochem. J. 262:971-976, 1989.
Durner, et al., Ketol-Acid Reductoisomerase from Barley (*Hordeum vulgare*): Purification, Properties, and Specific Inhibition, Plant Physiol. 103:903-910, 1993.
Feeney, et al., A single amino acid substitution in lactate dehydrogenase improves the catalytic efficiency with an alternative coenzyme, Biochem. Biophys. Res. Commun. 166:667-672, 1990.
Inui, et al., Identification and sequence determination of the acetohydroxy acid isomeroreductase gene from Brevibacterium flavum MJ233, DNA Seq. 4:95-103, 1993 (Abstract).
Lauvergeat, et al., Site-directed mutagenesis of a serine residue in cinnamyl alcohol dehydrogenase, a plant NADPH-dependent dehydrogenase, affects the specificity for the coenzyme, Biochemistry 34:12426-12434, 1995.
Levskaya, et al., Synthetic biology: engineering *Escherichia coli* to see light, Nature 438:441-442, 2005.
Shiraishi, et al., Engineering of pyridine nucleotide specificity of nitrate reductase: mutagenesis of recombinant cytochrome b reductase fragment of Neurospora crassa NADPH:Nitrate reductase, Archives of Biochemistry and Biophysics 358:104-115, 1998.
Tyagi, et al., Probing the mechanism of the bifunctional enzyme ketol-acid reducoisomerase by site-directed mutagenesis of the active site, FEBS Journal 272:593-602, 2005.
Zhang, et al., Change of nucleotide specificity and enhancement of catalytic efficiency in single point mutants of Vibrio harveyi aldehyde dehydrogenase, Biochemistry 38:11440-11447, 1999.
International Preliminary Report on Patentability dated Sep. 24, 2013 for International Application No. PCT/US2012/030479.
U.S. Appl. No. 13/428,585, filed Mar. 23, 2012.
EBI Accession No. UniProt: Q8ZAC2, Entry Date Jun. 6, 2003.
EBI Accession No. UniProt: Q0AV19, Entry Date Jan. 15, 2008.
EBI Accession No. UniProt: Q02138, Entry Date Jul. 1, 1993.
EBI Accession No. UniProt: Q01292, Entry Date Apr. 1, 1993.
EBI Accession No. UniProt: P06168, Entry Date Jan. 1, 1988.
EBI Accession No. UniProt: P05793, Entry Date Nov. 1, 1988.
EBI Accession No. UniProt: B1ZV88, Entry Date Jun. 6, 2003.
She, et al., Q97YJ9—UNIPROTKB/Swiss-Prot. Database, Oct. 31, 2006.
Suerbaum, et al., UniProtKB Database, Accession Q7VGW6, 2003.
Kaneko, et al., Q8YUM—UniProt Database, Mar. 23, 2010.
GenBank No. NC_009135.1, Methanococcus maripaludis C5, complete genome, Apr. 30, 2009.
GenBank No. NC_005791.1, Methanococcus maripaludis S2, complete genome, Apr. 25, 2009.
GenBank No. NZ_AAWX01000002.1, Copeland, et al., Feb. 7, 2007; pp. 1-3.
GenBank No. NC_001144.4, *Saccharomyces cerevisiae* chromosome XII, complete sequence, Jun. 16, 2008.
GenBank No. NC_002754.1, Sulfolobus solfataricus P2, complete genome, Apr. 26, 2009.

(56) References Cited

OTHER PUBLICATIONS

GenBank No. NC_003364.1, Pyrobaculum aerophilum str. IM2, complete genome, Apr. 24, 2009.
GenBank No. AAA25079, acetolactate synthase [Klebsiella pneumoniae], Aug. 5, 1994.
GenBank No. AAA25161, alpha-acetolactate synthase, Apr. 21, 1994.
GenBank No. AAA65614, keto acid dehydrogenase E1-alpha subunit [Pseudomonas putida] Feb. 27, 2002.
GenBank No. AAA65615, 39 kDa keto acid dehydrogenase El-beta subunit [Pseudomonas putida], Feb. 27, 2002.
GenBank No. AAA65617, transacylase E2 [Pseudomonas putida], Feb. 27, 2002.
GenBank No. AAA65618, lipoamide dehydrogenase [Pseudomonas putida], Feb. 27, 2002.
GenBank No. AAS49166, branched-chain alpha-ketoacid decarboxylase [Lactococcus lactis], Dec. 27, 2004.
GenBank No. AJ746364, *Lactococcus lactis* subsp. lactis kivd gene for alpha-ketoisovalerate decarboxylase, strain IFPL730, Apr. 15, 2005.
GenBank No. AY548760, Lactococcus lactis branched-chain alpha-ketoacid decarboxylase (kdcA) gene, complete cds, Dec. 27, 2004.
GenBank No. BX950229, Methanococcus maripaludis strain S2, complete sequence, May 8, 2008.
GenBank No. CAB14105, dihydroxy-acid dehydratase [*Bacillus subtilis* subsp. subtilis str, Oct. 1, 2009.
GenBank No. CAB14334, branched-chain alpha-keto acid dehydrogenase E2 subunit (lipoamide acyltransferase) [*Bacillus subtilis* subsp. subtilis str. 168], Oct. 1, 2009.
GenBank No. CAB14335, branched-chain alpha-keto acid dehydrogenase E1 subunit [*Bacillus subtilis*subsp. subtilis str. 168], Oct. 1, 2009.
GenBank No. CAB14336, branched-chain alpha-keto acid dehydrogenase E1 subunit [*Bacillus subtilis* subsp. subtilis str. 168], Oct. 1, 2009.
GenBank No. CAB14337, branched-chain alpha-keto acid dehydrogenase E3 subunit (dihydrolipoamide dehydrogenase) [*Bacillus subtilis* subsp. subtilis str. 168], Oct. 1, 2009.
GenBank No. CAB15618, alpha-acetolactate synthase [*Bacillus subtilis* subsp. subtilis str. 168], Oct. 1, 2009.
GenBank No. CAF29874, Dihydroxy-acid dehydratase [Methanococcus maripaludis S2], May 8, 2008.
GenBank No. CAG34226, alpha-ketoisovalerate decarboxylase [*Lactococcus lactis* subsp. lactis], Apr. 15, 2005.
GenBank No. L16975, Lactococcus lactis alpha-acetolactate synthase (als) gene, complete cds, Apr. 21, 1994.
GenBank No. M57613, Pseudomonas putida branched-chain keto acid dehydrogenase operon (bkdA1, bkdA1 and bkdA2), transacylase E2 (bkdB), bkdR and lipoamide dehydrogenase (IpdV) genes, complete cds, Feb. 27, 2002.
GenBank No. M73842, Klebsiella pneumoniae acetolactate synthase (iluk) gene, complete cds, Aug. 5, 1994.
GenBank No. NC_001142, Nosema ceranae BRLO1 Nc001142, whole genome shotgun sequence, Jun. 9, 2009.
GenBank No. NC_003030, Clostridium acetobutylicum ATCC 824, complete genome, Oct. 22, 2009.
GenBank No. NC_001136, *Saccharomyces cerevisiae* chromosome IV, complete sequence, Dec. 9, 2009.
GenBank No. NC_001145, *Saccharomyces cerevisiae* chromosome XIII, complete sequence, Dec. 9, 2009.
GenBank No. NC_001988, Clostridium acetobutylicum ATCC 824 plasmid pSOL1, complete sequence, Apr. 26, 2009.
GenBank No. NC_003197, *Salmonella typhimurium* LT2, complete genome, Mar. 30, 2010.
GenBank No. NP_012550, Dihydroxyacid dehydratase, catalyzes third step in the common pathway leading to biosynthesis of branchedchain amino acids; Ilv3p [*Saccharomyces cerevisiae*], Nov. 5, 2009.
GenBank No. NP_010656, Jacq, et al., downloaded Apr. 15, 2010, pp. 1-3.
GenBank No. NP_014051, Adh6p [*Saccharomyces cerevisiae*], Dec. 9, 2009.
GenBank No. NP_149189, pyruvate decarboxylase [Clostridium acetobutylicum ATCC 824], Apr. 26, 2009.
GenBank No. NP_349892, NADH-dependent butanol dehydrogenase A (BDH I) [Clostridium acetobutylicum ATCC 824], Apr. 14, 2010.
GenBank No. NP_417484, alcohol dehydrogenase, NAD(P)-dependent [*Escherichia coli* str. K-12 substr. MG1655], Apr. 9, 2010.
GenBank No. NP_461346, indolepyruvate decarboxylase [*Salmonella typhimurium* LT2], Apr. 30, 2009.
GenBank No. YP_026248, dihydroxyacid dehydratase [*Escherichia coli* str. K-12 substr. MG1655], Jul. 30, 2009.
GenBank No. Z99115, Bacillus subtilis complete genome (section 12 of 21): from 2207806 to 2409180, Nov. 15, 2007.
GenBank No. AL009126, *Bacillus subtilis* subsp. subtilis str. 168 complete genome, Oct. 1, 2009.
GenBank No. Z99122, Bacillus subtilis complete genome (section 19 of 21): from 3608981 to 3809670, Apr. 18, 2005.
GenBank No. ZP01224863.1, ketol-acid reductoisomerase [marine gamma proteobacterium HTCC2207], Mar. 24, 2006.
GenBank No. NC_003295.1, Ralstonia solanacearum GMI1000, complete genome, May 1, 2009.
GenBank No. NC_002516, Pseudomonas aeruginosa PAO1, Jul. 20, 2008.
GenBank No. NC_004129, Pseudomonas fluorescens Pf-5, Jul. 20, 2008.
GenBank No. ZP_01313517.1, ketol-acid reductoisomerase [Desulfuromonas acetoxidans DSM 684], May 15, 2006.
GenBank No. 082043, Ketol-acid reductoisomerase, chloroplastic, Jun. 16, 2009.
GenBank No. NP_977840.1, ketol-acid reductoisomerase [Bacillus cereus ATCC 10987], May 1, 2009.
GenBank No. NP_978252.1, ketol-acid reductoisomerase [Bacillus cereus ATCC 10987], May 1, 2009.
GenBank No. P05793, Daniels, et al., Jun. 16, 2009; pp. 1-9.
Entrez GenBank Accession No. Uniprot: Q6F821, Barbe, et al., Oct. 2004; pp. 1-2.
GenBank Accession No. Q4K608, ketol-acid reductoisomerase, Pseudomonas fluorescens, Aug. 2, 2005, viewed Nov. 14, 2008.
GenBank: EDR97797.1, ketol-acid reductoisomerase [Anaerostipes caccae DSM 14662], Aug, 4. 2012.
Vasantha, et al., Genes for Alkaline Protease and Neutral Protease from Bacillus amyloliquefaciens Contain a Large Open Reading Frame Between the Regions Coding for Signal Sequence and Mature Protein, J. Bacteriol., 159:811-819, 1984.
Pearson, Comput. Methods Genome Res., [Proc. Int. Symp.] (1994), Meeting Date 1992, 111-20. Editor(s): Suhai, Sandor. Plenum: New York, NY.
Altschul, et al., Basic Local Alignment Search Tool, J. Mol. Biol. 215:403-410, 1990.
Spano, et al., Environmental stress response in wine lactic acid bacteria: beyond Bacillus subtilis, Crit. Rev. Microbiol. 32:77-86, 2006.
Chang et al., Construction and Characterization of Amplifiable Multicopy DNA Cloning Vehicles Derived from the P15A Cryptic Miniplasmid, J. Bacteriol. 134:1141-1156, 1978.
Ferain, et al., Lactobacillus plantarum IdhL gene: overexpression and deletion, J. Bacteriol. 176:596-601, 1994.
Godon. et al., Branched-chain amino acid biosynthesis genes in *Lactococcus lactic* subsp. lactis, J. Bacteriol. 174:6580-6589, 1992.
Horinouchi, et al., Nucleotide sequence and functional map of pE194, a plasmid that specifies inducible resistance to macrolide, lincosamide, and streptogramin type B antibiotics, J. Bacteriol. 150:804-814, 1982.
Higgins, et al., CLUSTAL V: improved software for multiple sequence alignment, CABIOS 8:189-191, 1992.
Higgins et al., Fast and sensitive multiple sequence alignments on a microcomputer, CABIOS Communications 5:151-153, 1989.
Johnson, et al., DNA sequences at the ends of transposon Tn5 required for transposition, Nature 304:280-282, 1983.
Rud, et al., A synthetic promoter library for constitutive gene expression in Lactobacillus plantarum, Microbiol. 152:1011-1019, 2006.

(56) References Cited

OTHER PUBLICATIONS

Yansura, et al., Use of the *Escherichia coli* lac repressor and operator to control gene expression in Bacillus subtilis, Proc. Natl. Acad. Sci. USA, vol. 81:439-443, 1984.
Yuan, et al., Regulatlon of groE Expression In Bacillus subtills: the Involvement of the cr-Like Promoter and the Roles of the Inverted Repeat Sequence (CIRCE), J. Bacteriol. 177:5427-5433, 1995.
Methods in Yeast Genetics, 2005, Cold Spring Harbor Laboratory Press, Cold Spring Harbor, NY, pp. 201-202.
Butanols, Ullman's Encyclopedia of Industrial Chemistry, 6th Edition, 5:716-719, 2003.
GenBank Accession No. B9CVH4, viewed Feb. 8, 2011.
GenBank Accession No. NC_000913, *Escherichia coli* str. K-12 substr. MG1655, May 17, 2008.
GenBank Accession No. NC_002505, *Vibrio cholerae* O1 biovar eltor str. N16961, Jul. 21, 2008.
GenBank Accession No. AAU36450, Psuedomonas aeruginosa cellular proliferation protein, Feb. 14, 2002, viewed Nov. 14, 2008.
GenBank Accession No. A3EGY6, ketol-acid reductoisomerase, Vibrio chlorea, Mar. 20, 2007, viewed Nov. 14, 2008.
GenBank Accession No. YP_162876, ketol-acid reductoisomerase [*Zymomonas mobilis* subsp. mobilis ZM4 = ATCC 31821], Jun. 10, 2013.
GenBank Accession No. ZP_07930881, ketol-acid reductoisomerase [*Anaerostipes* sp. 3_2_56FAA], Nov. 27, 2012.
Carlquist, Magnus et al., Genetically engineered *Saccharomyces cerevisiae* for kinetic resolution of racemic bicyclo[3.3.1]nonane-2,6-dione, Tetrahedron: Asymmetry, 2008, pp. 2293-2295, vol. 19.
Eglinton, Jeffrey M. et al., Decreasing acetic acid accumulation by a glycerol overproducing strain of *Saccharomyces cerevisiae* by deleting the ALD6 aldehyde dehydrogenase gene, Yeast, 2002, pp. 295-301, vol. 19.
Fujisawa, Hisae et al., Characterization of short-chain dehydrogenase/reductase homologues of *Escherichia coli* (YdfG) and *Saccharomyces cerevisiae* (YMR226C), Biochimica et Biophysica Acta, 2003, pp. 89-94, vol. 1645.
Johanson, Ted et al., Strain engineering for stereoselective bioreduction of dicarbonyl compounds by yeast reductases, FEMS Yeast Research, 2005, pp. 513-525, vol. 5.
Overcamp, Karin M. et al., Metabolic Engineering of Glycerol Production in *Saccharomyces cerevisiae*, Applied and Environmental Microbiology, Jun. 2002, pp. 2814-2821, vol. 68, No. 6.
Wurdig, G. et al., Occurrence, detection, and determination of 2- and 3-methyl-2,3-dihydroxybutyric acid and 2-hydroxyglutaric acid in wine, From the Wine Research Institute of the State Viticultural, Horticultural, and Agricultural Training and Research Center, Trier, 1969, pp. 216-230, Vitis 8.
Yang, Yan et al., Enzymatic ketone reduction: mapping the substrate profile of a short-chain alcohol dehydrogenase (YMR226c) from *Saccharomyces cerevisiae*, Tetrahedron: Asymmetry, 2007, pp. 1799-1803, vol. 18.

Katz, Michael et al., Efficient Anaerobic Whole Cell Stereoselective Bioreduction With Recombinant *Saccharomyces cerevisiae*, Biotechnology and Bioengineering, Dec. 5, 2003, pp. 573-582, vol. 84, No. 5.
Bianci, Michele M. et al., the 'petite-negative' yeast Kluyveromyces lactis has a single gene expressing pyruvate decarboxylase activity, Molecular Microbiology, 1996, pp. 27-36, vol. 19, No. 1.
Hohmann, Stefan, Characterisation of PDC2, a gene necessary for high level expression of pyruvate decarboxylase structural genes in *Saccharomyces cerevisiae*, Mol. Gen. Genet., 1993, pp. 657-666, vol. 241.
Saint-Prix, Florence et al., Functional analysis of the ALD gene family of *Saccharomyces cerevisiae* during anaerobic growth on glucose: the NADP+-dependent Ald6p and Ald5p isoforms plays a major role in acetate formation, Microbiology, 2004, pp. 2209-2220, vol. 150.
Johnson, Monique A. et al., Positive Selection of Novel Peroxisome Biogenesis-Defective Mutants of the Yeast Pichia pastoris, Genetics, Apr. 1999, pp. 1379-1391, vol. 151.
Wang, Xinping et al., Molecular Cloning, Characterization, and Potential Roles of Cytosolic and Mitochondrial Aldehyde Dehydrogenases in Ethanol Metabolism in *Saccharomyces cerevisiae*, Journal of Bacteriology, Feb. 1998, pp. 822-830, vol. 180, No. 4.
Navarro-Avino, Juan P. et al., A Proposal for Nomenclature of Aldehyde Dehydrogenases in *Saccharomyces cerevisae* and Characterization of the Stress-Inducible ALD2 and ALD3 Genes, Yeast, 1999, pp. 829-842, vol. 15.
Nevoigt, Elke et al., Reduced Pyruvate Decarboxylase and Increased Glycerol-3-phosphate Dehydrogenase [NAD+] Levels Enhance Glycerol Production in *Saccharomyces cerevisiae*, Yeast, 1996, pp. 1331-1337, vol. 12.
Flikweert, Marcel T. et al., Pyruvate Decarboxylase: An Indispensable Enzyme for Growth of *Saccharomyces cerevisiae* on Glucose, Yeast, 1996, pp. 247-257, vol. 12.
Nomura, Yukihiro et al., Preparation and Preservation of Freeze-dried Cells of Acetic Acid Bacteria with Aldehyde Oxidase Activity, Bioscience Biotechnology Biochemistry, 1998, pp. 1134-1137, vol. 62, No. 6.
Kaneko, Tetsuo et al., Secoiridoid and Flavonoid Glycosides From Gonocaryum Calleryanum, Phytochemistry, 1995, pp. 115-120, vol. 39, No. 1.
Bakker, Barbara M. et al., Stoichiometry and compartmentation of NADH metabolism in *Saccharomyces cerevisiae*, FEMS Microbiology Reviews, 2001, pp. 15-37, vol. 25.
Kumanovics, et al. Identification of FRA 1 and FRA2 as genes involved in regulating the yeast iron regulon in response to decreased mitochondrial iron-sulfur cluster synthesis. J. Biol. Chem. 283:10276-10286, 2008.

\* cited by examiner

```
K9   (1)    MEECKMAKIYQEDCNLSLLDGKTLAVIGYGSCGHAHALNAKESGCNVII
PF5  (1)    ------MKVFYDKDCDLSIIQGKKVALIGYGSCGHAQACNLKDSGVDVTV

K9   (51)   GLYEGSKSWKRAEEQGFEVYTAAEAAKKADIIMLINDEKQATMYKNDIE
PF5  (45)   GLRRGSATVAKAEAHGLKVTDVAAVAGADLVMLIPDEFQSLYKNEIE

K9   (101)  PNLEAGNMLMFAHGFNIHFGCIVPPKDVDVTMIAPKGPGHTVRSEYEEGK
PF5  (95)   PNIKKGATLAFSHGFAIHYNQVPRADLDVLMIAPKAPGHTVRSEFVKGG

K9   (151)  GVPCLVAVEQDATGKALDMALAYALAIGGARAGVLETTFRTETETDLFGE
PF5  (145)  GIPDLIAIYQDASGNAKNVALSYAAGVGGRTGIIETTFKDETETDLFGE

K9   (201)  QAVLCGGVCALMQAGFETLVEAGYDPRNAYFECIHEMKLIVDLIYQSGFS
PF5  (195)  QAVLCGGTVELVKAGFETLVEAGYAPEMAYFECLHELKLIVDLMYEGGIA

K9   (251)  GMRYSISNTAEYGDYITGPKIITEDTKKAMKKILSDIQDGTFAKDFLVDM
PF5  (245)  NMNYSISNNAEYGEYVTGPEVINAESRQAMRNALKRIQDGEYARMFISEG

K9   (301)  SDAGSQVHFKAMRKLASEHPAEVVGEEIRSLYSWSDEDKLINN---
PF5  (295)  --ATGYPSMTAKFRNNAAHGIEIIGEQLRSMMPWIGANKIVDKAKN
```

```
S2        (150) GGVPCLVAVDQDASGNAHDIALAYASGIGGRSGVIETTEREEVETDLFG
K25       (142) FAVPALFAVYQDATGNAQETALSYAKGIGATRVGVLETTFKEETETDLFG
K26       (145) FGVPALYAVYQDATGNAKDIAMDWCKGIGAARVGLLETTYKEETEEDLFG
L. Lactis (145) FGTPALFVSHQNASGHAREIAMDWAKGIGCARVGIIETTFKEETEEDLFG K9        (200) EQAVLCGGVCALMQAGFETIVEAGYDPRNAYFECIHEMKLIVDLIYQSGF
K1        (196) EQDVLMGGINHLCDMGFDVLTEAGYIQPELAYFEVFHELKMLVDLANEGGL
K2        (196) EQNVIMGGVNKLVEMGFEVLTDAGYQPELAYFEVCHELKMLVDLMNEGGL
K7        (195) EQAVLCGGVSELIKAGFETIVEAGYAPENAYFECMHEMKLIVDLLYQGGL
S2        (200) EQAVLCGGLTALITAGFETLTEAGYAPRMAFFECMHEMKLIVDLIYEAGI
K25       (192) EQAVLCGGLTSMIETGFETIVEAGYQPELAYFEVCHEMKLIVDLIYEGGF
K26       (195) EQAVLCGGLTALIETGFEVLTEAGYAPELAYFEVLHEMKLIVDLIYEGGF
L. Lactis (195) EQAVLCGGLTALVEAGFETLTEAGYAGELAYFEVLHEMKLIVDLMYEGGF K9        (250) SGMRYSISNTAEYGDYITGPKIITEDTRKAMKKILSDIQDSTFAKDELVD
K1        (246) NKARWSCSDTAQYGDYTS---TVITEETKKRMQYQLKRIQDGSFAKEFMDD
K2        (246) NKARWSCSDTAQYGDYTN---TVINEDCRKRMQYHLGRIQDGSFAKEFIDD
K7        (245) SMMRYSISDTAEYGDYQIGRRIITDETRKEMKKVLTEIQDSTFAKNWLIE
S2        (250) ANMRYSISNTAEYGDIVSGPRVINEESKKAMKAILDDIQSGRFVSKFVLD
K25       (242) AKMRDSISNTAEYGDYVSGSRIITEQTKANMKNVLKDIQNGTFAKGFIAD
K26       (245) KKMRQSISNTAEFGDYVSGPRVITEQVKENMKAVLADIQNGKFANDFVND
L. Lactis (245) TKMRQSISNTAEFGDYVTGPRIITDEVKKNMKLIVLADIQSGKFAQDFVDD K9        (300) MSDAGSQVRFKAMRKLASEHPAEVVGEETRSLYSWSDEDKLINN------
K1        (294) QAAG--APKFKKLQEEYSHPBLETVGPKLKRAMFSWNNQVDADADMAESFN
K2        (294) QDAG--APKFKELQEEYGNVRIETVGPKLRAMFSWNNGQDDDADMAT-ET
K7        (295) NQTN---RPGFNARRRMEAEHPIEKVGKELRGMNSWIDTAKVD------
S2        (300) NRAG---QPELKAARKRMAAHPIEQVGARLRKMPWIASNKIVDKARN-KL
K25       (292) NQAG---FPEFKKMREQNGNHIPIEKVGSELRKMMPFVTKD--------
K26       (295) YKAG---RPKLTAYREEAANLEIEKVGAELRKAMPFVGQNDDDAFKIYN--
L. Lactis (295) FKAG---RPKLIAYREAAKNLEIEKIGAELRQAMPFTQSGDDDAFKIYQ--
```

| | | |
|---|---|---|
| K9 | (344) | ---------- |
| K1 | (342) | GKIARTQVQ |
| K2 | (341) | GKIARSQVQ |
| K7 | (335) | ---------- |
| S2 | (347) | GCE------- |
| K25 | (329) | ---------- |
| K26 | (341) | ---------- |
| L. Lactis | (341) | ---------- |

```
                     51                                                                        100
AABY01000127    .........................................   ..  ..........  ..........
AACH01000019    .........................................   .AT GTCCCAAGGT AGAAAAGCTG
AACA01000631    .........................................   .AT GTCTCAAGGT AGAAAAGCTG
AACF01000116    .........................................   .AT GTCCCAAGGT AGAAAAGCTG
       AE016819 .........................................   .AT GTCTCAAAGGT CCTAAAGCTG
       CR382139 .........................................   .AT GTCCCTAGGA AGAAAAGCTG
XM_001387479    .........................................   .AT GTCGTACGGA TCTAAAGCTG
XM_001482184    GAGTGTGGAG ATTAAATCCT CAATCTTCAT ..........   .AT GTCGTTTGGA AAAAAAGCTG
XM_002419771    .........................................   .AT GTCTTTCCGT GCCAAAGCCG
       CR380959 .........................................   .AT GTCATTTGGT AGAAAAGCTG
XM_001645671    .........................................   .AT GTCTCAAGGA AGAAAAGCTG
  SAKL0H04730   .........................................   .AT GTCACAGGGT AGAAGGCTT
     XM_451902  .........................................   .AT GTCTCAAGGT AGAAGGGCTG
XM_002553230    .........................................   .AT GTCACAGGGA AGAAGAGCAG
XM_002494574    .........................................   .AT GTCACAAGGT GTCAAAGCTG
       YMR226C  .........................................   .AT GTCCCAAGGT AGAAAAGCTG
NM_001018495    .........................................   ...  .........  ..........
     XM_501554  .........................................   .AT GTCTTTCGGA GATAAAGCTG
     XM_957621  .........................................   .AT GTCCTCAGC.  .....AGTAG

FIG. 12B
```

|  | 101 |  |  |  |  | 150 |
|---|---|---|---|---|---|---|
| AABY01000127 | CAGAAA.GAT | TGGCTAAACAA | GACCGTGCTC | ATTACGGGTG | CCTCTGCTGG |
| AACH01000019 | CAGAAA.GAT | TGGCTGGCAA | AACCGTTCTC | ATCACGGGTG | CCTCTGCTGG |
| AACA01000631 | CAGAAA.GAT | TGGCCAACAA | GACGGTGCTC | ATTACAGGCG | CTTCTGCTGG |
| AACF01000116 | CCGAAA.GAT | TGAATGAGAA | GATTGTGTTT | ATCACTGGTG | CTTCAGCTGG |
| AE016819 | CTGAAA.GAT | TAGCCAACAA | AATTGTGCTT | GTGACTGGTG | CCTCTGCGGG |
| CR382139 | CTGAAC.GTG | TTGCCAATAA | GATTGTCTTA | ATCACTGGTG | CTTCATCTGG |
| XM_001387479 | CTGAAA.GAC | TTGCCAACAA | AATCATTCTT | ATCACCGGGG | CTTCGTCTGG |
| XM_001482184 | CTGAAC.GCC | TTGCCAACAA | GATCATATTG | ATCACTGGGG | CATCGTCTGG |
| XM_002419771 | CTGAGA.GAT | TAGCCAATAG | ATCCATTCTT | ATCACTGGTG | CTTCATCTGG |
| CR380959 | CTGAGA.GGT | TACAAGGGAA | GATTGCCTTT | ATTACGGGTG | CCTCTGCGGG |
| XM_001645671 | CAGAAA.GGT | TGGCTGGTAA | AACTGTATTA | ATTACAGGTG | CTTCATCAGG |
| SAKL0H04730 | CAGAAA.GAC | TAGCAAACAA | GACCGTTTTC | ATTACCGGTG | CCTCTGCCGG |
| XM_451902 | CTGAAA.GAT | TGCAAAACAA | GACAATGTCTTC | ATCACAGGGG | CTTCTGCAGG |
| XM_002553230 | CTGAAA.GAC | TGGCAGGGAAA | GACTGTCTTC | ATCACAGGCG | CATCAGCCGG |
| XM_002494574 | CTGAAA.GAC | TAGCTGGTAA | GACTGTATTC | ATTACAGGTG | CTTCTGCAGG |
| YMR226C | CAGAAA.GAT | TGGCTAAGAA | GACTGTCCTC | ATTACAGGTG | CATCTGCTGG |
| NM_001018495 | ATGAGCCGTT | TGGATGGAAA | AACGATTTTA | ATCACTGGTG | CCTCTTCTGG |
| XM_501554 | CTGCTC.GAC | TTGCGGGCAA | GACCGTCTTT | GTTACCGGCG | CCTCGTCCGG |
| XM_957621 | CCAAGC.GCC | TCGCGGGCAA | GACCATTGTC | ATAACCGGAG | CGTCCTCAGG |

FIG. 12C

|            | 151                                                              | 200 |
|---|---|---|
| AABY01000127 | TATTGGTAAG GCCACCGCAT TAGAGTATTT G...GAGGCA TCCAATGGTG |
| AACH01000019 | TATTGGCAAA GCCACTGCAT TAGAGTATTT G...GAGGCA TCCAATGGCG |
| AACA01000631 | TATTGGTAAG GCCACCGCAT TGGAGTATTT G...GAAGCA TCCAATGGAA |
| AACF01000116 | TATTGGGCAA GCCACCGCTT TGGAATACAT G...GATGCG TCGAACGGTA |
| AE016819    | CATTGGCCGT GCTACAGCCA TTAACTATGC A...GACGCG ACGGACGGGG |
| CR382139    | AATTGGTGAA GCAACTGCCA AAGAAATTGC A...TCAGCC GCTAATGGCA |
| XM_001387479 | TATTGGTGAA GCTACAGCTA GAGAGTTTGC A...TCTGCT GCCAATGGGA |
| XM_001482184 | TATAGGCGAG GCTACCGCCA GAGAATTCGC T...GCTGCT GCCAATGGAA |
| XM_002419771 | GATTGGTGAA GCATGTGCTA AAGTTTTCGC T...GAAGCA TCTAATGGTC |
| CR380959    | CATCGGTCAA GCTACAGCCA TTGAGTATTT G...GATGCT TCCAATGGTA |
| XM_001645671 | GATTGGGAAA GCCACTGCAT TAGAATATCT A...GATGCC TCTAACGGTA |
| SAKL0H04730 | CATTGGCCAA GCTACTGCTT TGGAATACTG T...GATGCT TCTAACGGTA |
| XM_451902   | TATCGGTCAA GCCACAGCAT AAGAATATCT A...GATGCT GCTAACGGTA |
| XM_002553230 | TATCGGTCAG GCCACTGCGC AAGAATACCT G...GAAGCA TCCGAAGGCA |
| XM_002494574 | TATCGGTCAA GCAACTGCAA AGGAATATTT G...GATGCA TCCAATGGTC |
| YMR226C     | TATTGGTAAG GCGACCGCAT TAGAGTACTT G...GAGGCA TCCAATGGTG |
| NM_001018495 | AATTGGAAAA AGCACTGCTT TTGAAATTGC C...AAAGTT GCCAAAG... |
| XM_501554   | CATTGGCCAG GCCACTGTTC TCGCTCTAGC C...GAAGCT GCCAAGGGCG |
| XM_957621   | AATCGGGGCGT AGCACAGCCT TCGAGTTTGC GCGGACCGCG CCCAACCACG |

FIG. 12D

|              | 201 |  |  |  |  |  | 250 |
|---|---|---|---|---|---|---|---|
| AABY01000127 | ATATGAAACT | GGTCTTAGCT | GCTAGAAGAT | TAGAAAAGCT | CGAGGAATTA |
| AACH01000019 | ATATGAAATT | AATCTTAGCC | GCTAGAAGAT | TAGAAAAGCT | CGAGGAATTG |
| AACA01000631 | ACATGAAACT | GATCTTGGCT | GCGAGGAGAT | TGGAGAAGCT | AGAGGAGCTG |
| AACF01000116 | CTGTGAAATT | GGTTCTAGTT | GCCAGAAGAT | TGGAGAAATT | ACAACAATTG |
| AE016819 | CAATCAAGTT | GATTTTGGTG | GCAAGACGCG | CAGAAGAGCT | CACCAGCTTG |
| CR382139 | ATTTAAAATT | AGTGTTGTGT | GCTAGACGAA | AAGAAAAGCT | GGATAATTTA |
| XM_001387479 | ATATCAGATT | GATTTTGACA | GCCAGAAGAA | AAGAAAAGTT | GGCTCAATTG |
| XM_001482184 | AAATTCTGTT | GATTTGACC | GCTCGGAGAG | AAGACAAACT | CAAGTCTCTC |
| XM_002419771 | AAGTTAAATT | AGTTTTAGGA | GCAAGAAGAA | AAGAACGATT | AGTTAAATTA |
| CR380959 | GTGTGAAGCT | AGTTCTTGGT | GCACGTAGAA | TGGAGAAATT | GGAGGAGTTG |
| XM_001645671 | ATATGAAATT | AATTTTAGTT | GCAAGAAGAT | TAGAAAAAATT | GCAAGAGTTG |
| SAKL0H04730 | AAATAAAACTT | GGTGTTTAAGT | GCCAGAAGGC | TGGAAAAATT | GCAAGAGTTA |
| XM_451902 | ATGTCAAATT | GATCTTAGCA | GCAAGAAGGT | TGGCTAAGTT | GGAAGAATTG |
| XM_002553230 | AAATCAAGTT | GATCCTTGCA | GCAAGAAGAC | TCGACAAGCT | GGAGGAAATC |
| XM_002494574 | AAATTAAAATT | GATCTTGGCT | GCAAGAAGAT | TAGAAAAGCT | ACACGAGTTT |
| YMR226C | ATATGAAACT | GATCTTGGCT | GCTAGAAAGAT | TAGAAAAGCT | CGAGGAATTG |
| NM_001018495 | ...TAAAAACT | TATTTTGGCT | GCTCGCAGAT | TTTCTACCGT | TGAAGAAATT |
| XM_501554 | ACCTCAAGTT | TGTGCTTGCT | GCCCGACGAA | CCGACCGTCT | GGACGAGCTC |
| XM_957621 | GCCTCAAGCT | GATCTTGACG | GCCCGCCGCG | TCGATGCCCT | GGAGCAGATT |

FIG. 12E

```
                 251                                                         300
AABY01000127     AAGAAAAACTA TTGATCAGG. AGTTTCCA.. AACGCCAAAG TTCATGTGGC
AACH01000019     AAGAAGACTA. TCGATGAAG. AGTTTCCA.. AACGCAAAGG TCCATGTGAC
AACA01000631     AAGAAGACCA  TCGACGAGG. AGTTTCCC.. AATGCAAAGG TTCACGTTGG
AACF01000116     AAGGAAGTCA  TTGAGGCAA. AATACCCT.. AAGAGTAAAG TCTATATTGG
AE016819         AAACAGGAGA  TCGA.AAGCA AGTATCCC.. AACGCCAAGA TCCATGTCGG
CR382139         TCT.AAAGAA  TTGACTGACA AATATTCA.. TCCATCAAGG TTCATGTTGC
XM_001387479     TCA.GACTCA  TTGACCAAGG AATTTCCA.. ACTATCAAAA TCCATTCTGC
XM_001482184     TCG.CAACAA  TTGAGCCTCA TTTACCCG.. CAAATTAAAA TCCATTCTGC
XM_002419771     TCT.GATACT  TTAATTAAAC AATATCCT.. AATATTAAAA TTCATCATGA
CR380959         AAG.AAGGAA  TTGCTGGCTC AATATCCT.. GATGCAAAGA TTCATATAGG
XM_001645671     AAGGAAACAA  TTTGTAAAG. AATATCCA.. GAATCTAAGG TTCATGTTGA
SAKL0H04730      AAGGACAAAA  TCACCAAGG. AGTATCCT.. GAAGCCAAGG TTTATATTGG
XM_451902        AAGGAAAAAA  TCAATGCTG. AATACCCA.. CAAGCTAAAG TATATATCGG
XM_002553230     AAAGCCAAGG  TTTCTAAAG. ACTTCCCT.. GAAGCACAGG TGCATATCGG
XM_002494574     AAAGAACAAA  CTAC.AAAGA GTTACCCA.. AGCGCTCAAG TCCACATTGG
YMR226C          AAGAAGACCA  TTGATCAAG. AGTTTCCA.. AACGCAAAAG TTCATGTGGC
NM_001018495     GCAAAGGAGT  TAGA.ATCGA AATAT..... GAAGTATCGG TTCTTCCTCT
XM_501554        AAGAAGGAAGC TGGAGACCG. ACTACAAG.. GGTATCCAGG TGCTGCCTTT
XM_957621        GCCAAGGAGA  TCCGCCAAGA GGTTGGCGAG GGCGTGCAAG TGCTGCCTGT

FIG. 12F
```

|  | 301 | | | |
|---|---|---|---|---|
| AABY01000127 | CCAACTGGAT | ATCACTCAAG | CAGAAAAGAT | CAAGCCCTTT ATTGAGAATT |
| AACH01000019 | CAAACTGGAC | ATCACACAGA | CAGAAAAGAT | CAAGCCCTTT ATTGAAAACT |
| AACA01000631 | CCAACTGGAT | ATCACACAGG | CCGAGAAGAT | CAAGCCCTTC ATTGAAAACT |
| AACF01000116 | GAAGTTGGAT | GTGACAGAGC | TTGAGACCAT | TCAACCATTC TTGGATAATC |
| AE016819 | ACAATTGGAT | GTGACCCAAC | TGGAGACCAT | CCGCCCATTT TTGGAGGGAC |
| CR382139 | TCAACTAGAT | GTATCTAAGC | TCGAGACTAT | CAAGCCATTT ATCAATGATT |
| XM_001387479 | CAAATTGGAT | GTGACCGAAC | ATGATGGCAT | CAAGCCTTTC ATTTCTGGTT |
| XM_001482184 | TCGTCTTGAT | GTCTCTGAGT | TTTCGTCACT | TAAGCCGTTC ATTACTGGGT |
| XM_002419771 | TTTTTTGGAT | GTTACTATTA | AAGATTCAAT | TTCAAAATTC ATTGCTGGAA |
| CR380959 | TAAACTGGAT | GTTACAGACT | TTGAAAACGT | CAAGCAGTTT TTGGCTGACT |
| XM_001645671 | AGAATTAGAT | ATTTCTGATA | TTAATAGAAT | CCCAGAATTT ATTGCAAAAT |
| SAKL0H04730 | TGTGCTTGAT | GTGACCGAAA | CGGAAAAAAT | CAAACCATTC TTGGATGGTT |
| XM_451902 | TCAATTGGAT | GTCACTCAGA | CTGAGAAGAT | TCAACCTTTC ATTGATAACT |
| XM_002553230 | CCAGCTAGAT | GTGACTCAGA | CGGACAAAAT | CCAGCCCTTT GTCGACAATT |
| XM_002494574 | TAAATTGGAC | GTCACTGCAA | TTGACACCAT | AAAACCATTT TGGATAAAT |
| YMR226C | CCAGCTGGAT | ATCACTCAAG | CAGAAAAAAT | CAAGCCCTTC ATTGAAAACT |
| NM_001018495 | TAAATTGGAT | GTTTCTGATT | TGAAGTCTAT | TCCTGGGGTA ATTGAGTCAT |
| XM_501554 | CAAGCTGGAC | GTGTCCAAGG | TCGAGGAGAC | CGAGAACATT GTGTCCAAGC |
| XM_957621 | CAAGCTGGAC | GTCAGCCAGC | CGGAGGAGGT | CAGGGGTTT GTTGGGAACT |

FIG. 12G

|              | 351         |            |            |            | 400        |
|---|---|---|---|---|---|
| AABY01000127 | TGCCAAAGGA  | GTTCAAAGAC | ATTGACATTT | TGGTGAACAA | CGCTGGGAAG |
| AACH01000019 | TGCCAGAGGA  | GTTCAAAGAA | ATTGATATTC | TGGTGAACAA | CGCTGGTAAG |
| AACA01000631 | TGCCGGAGGC  | ATTCAAGGAT | ATTGACATCC | TGATAAACAA | TGCCGGCAAA |
| AACF01000116 | TTCCTGAGGA  | ATTTAAGGAT | ATTGATATCT | TGATTAATAA | TGCCGGGAAG |
| AE016819     | TACCTGAGGA  | GTTCCGAGAC | ATTGATATTT | TAATTAACAA | CGCAGGTAAG |
| CR382139     | TACCGAAAGA  | ATTCTCTGAC | GTGGATGTAT | TAGTCAACAA | TGCAGGCTTG |
| XM_001387479 | TACCCAAGGA  | TTTTGCCGAC | ATCGATGTGT | TGATCAACAA | TGCTGGAAAA |
| XM_001482184 | TGCCAAAGGA  | TTTTGCTAGC | ATCGACGTTT | TGGTGAATAA | TGCGGGGAAA |
| XM_002419771 | TTCCTCATGA  | ATTTG...AAC | CT.GATGTAT | TAATTAATAA | TAGTGGTAAA |
| CR380959     | TGCCAGAAGA  | GTTCAAGGAC | ATCGACATCC | TGATCAACAA | CGCTGGTAAA |
| XM_001645671 | TACCTGAAGA  | ATTCAAAGAT | ATTGATAGAT | ATTGATAACAA | TGCAGGTAAA |
| SAKL0H04730  | TACCAGAAGA  | ATTTAAAGAT | ATCGATATCT | TGATCAACAA | TGCAGGCAAA |
| XM_451902    | TGCCGGAAGA  | GTTCAAAGAC | ATCGACATCC | TGATCAACAA | CGCGGGCAAG |
| XM_002553230 | TGCCCGAAGA  | GTTCAAAGAA | ATCGACATTC | TGATCAACAA | TGCCGGTAAG |
| XM_002494574 | TACCAAAGGA  | ATTTCAAGAT | ATCGATATTT | TGATCAACAA | TGCCGGAAAG |
| YMR226C      | TGCCACAAGA  | GTTCAAGGAT | ATTGACATTC | TGGTGAACAA | TGCTGGACTT |
| NM_001018495 | TGCCAAAGGA  | ATTTGCTGAT | ATCGATGTCT | TGATTAATAA | CGCCGGCATG |
| XM_501554    | TGCCCAAGGA  | GTTTTCCGAG | GTGGACGTGC | TTATCAACAA | CGCCGGCATG |
| XM_957621    | TGCCCGAGGA  | GTGGAGGGAT | ATCCATGTGC | TGGTCAATAA | TGCTGGTCTC |

FIG. 12H

|                | 401        |            |            |            | 450        |
|----------------|------------|------------|------------|------------|------------|
| AABY01000127   | GCCCCTTGGTA | CCGACCGTGT | GGGGGAGATT | GCAACACAAG | ATATCCAGGA |
| AACH01000019   | GCTCTTGGTA | CGGACCGTGT | TGGGGAGATT | GATACACAGG | ACGTCCAGGA |
| AACA01000631   | GCCCTGGGCT | CCGAACGTGT | CGGGGAAATT | GCCACACAGG | ACATCCAGGA |
| AACF01000116   | GCATTAGGTT | CCGATCGTGT | AGGTGATATT | GATATAAAAG | ATGTGAAGGG |
| AE016819       | GCCCTCGGCA | CTGAGAGGGT | GGGGGAAATC | TCGATGGACG | ATATCCAGGA |
| CR382139       | GCTTTGGGCC | GTGATGAAGT | TGGAACCATT | GACACAGATG | ATATGTTATC |
| XM_001387479   | GCTCTTGGAA | AAGCATCTGT | TGGTGAAATC | AGTGACAGTG | ATATCCAAGG |
| XM_001482184   | GCATTGGGAA | GAGCCAATGT | TGGTGAAATT | TCCCAAGAGG | AAATCAATGG |
| XM_002419771   | GCCCTTGGGA | AAGAAGAAGT | TGGAGAATTG | AAAGATGAAG | ATATTACGGA |
| CR380959       | GCGTTGGGGT | CTGACAAAGT | TGGAGACATT | GACCCTGAGG | ATATCGCAGG |
| XM_001645671   | GCATTAGGAA | GTGATACTAT | TGGTAATATC | GAGAATGAGG | ATATTAAAGG |
| SAKL0H04730    | GCGTTAGGCT | CTGATCCTGT | TGGTACCATC | AAAACTGAAG | ATATTGAAGG |
| XM_451902      | GCTTTTGGGAT | CTGATGTTGT | CGGTACCAGG | AGTAGCGAGG | ACATCCAAGG |
| XM_002553230   | GCGCTCGGAT | CCGACCCCGT | GGGCACAATC | GACCCCAATG | ATATTCAAGG |
| XM_002494574   | GCATTAGGTA | CTGATAAAGT | TGGTGATATT | GCAGATGAAG | ACGTGGAAGG |
| YMR226C        | GCTCTTGGCA | GTGACCGTGT | GGGCCAGATC | GCAACGGAGG | ATATCCAGGA |
| NM_001018495   | GCTCTAGGTA | CCGATAAAGT | CATTGATCTT | AATATTGATG | ACGCCGTTAC |
| XM_501554      | GTCCACGGCA | CCGAAAAAGG | TGGCTCCATC | AACCAGAACG | ACATTGAGAT |
| XM_957621      | GTAAAAGG.. | .....A..GC | TCCCTCCATC | GCCGAAGAAG | ACATCAACGT |

FIG. 12I

```
                451
AABY01000127    TGTGTTTTGAC ACCAACGTCA CAGCTTTTAAT TAATATCACT CAAGCTGTGC  500
AACH01000019    CGTGTTCGAC ACCAACGTCT CGGCTTTTGAT TAATGTCACA CAGGCTGTTC
AACA01000631    CGTGTTCGAC ACCAACGTCA CGGCGTTTGAT CAACGTCACG CAAGCAGTGC
AACF01000116    AATGATGGAT ACCAATGTCT TGGGGTTGAT CAATGTGACG CAAGCTGTGT
AE016819        GGTTTTCAAC ACTAATGTTA TCGGCTTGGT GCACTTGACT CAGGAGGTTC
CR382139        GATGTTTCAA ACTAATGTTT TAGGGTTAAT TACCATCACA CAGGCTGTTT
XM_001387479    CATGATGCAA ACGAATGTCT TGGGACTCAT CAACATGACT CAGGCTGTGA
XM_001482184    CATGTTCCAT ACCAATGTCC TTGGGTTGAT AAACTTAAACT CAGGAGGTGT
XM_002419771    AATGTTTGAT ACTAATGTCA TTGGAGTCAT TCGTATGACT CAAGCAGTTT
CR380959        AATGTTTAAC ACCAACGTCC TTGCATTGAT CAATTAACA CAATTGTTGT
XM_001645671    TATGTTTGAG ACTAACGTTT TTGGATTAAT CTGTTTAACA CAAGCTGTAC
SAKL0H04730     AATGATCAAC ACCAACGTTG TAGCTCTTAT CAATATTACT CAAGCTGTCT
XM_451902       TATGATAGAT ACTAACGTTG TTGCCCTTAT CAACGTTACC CAAGCTGTTT
XM_002553230    CATGATCCAG ACTAACGTTA TCGGGCTTAT AAATGTTACC CAAGCCGTTC
XM_002494574    TATGTTCGAC ACCAATGTCT TGGGGTTAAT CAAAGTTACT CAAGCTGTTT
YMR226C         CGTGTTCGAC ACCAACGTCA CGGCTTTTAAT CAATATCACA CAAGCTGTAC
NM_001018495    CATGATTACT ACCAATGTTC TTGGTATGAT GGCTATGACT CGTGCGGTTC
XM_501554       CATGTTCCAC ACAAACGTGC TCGGACTCAT TTCTGTCACT CAGCAGTTTG
XM_957621       CATGTTTGCC ACCAACGTCA CCGGCCTGAT CAACATGACC CAAGCCATCC

FIG. 12J
```

| | 501 | | | | 550 |
|---|---|---|---|---|---|
| AABY01000127 | TGCCCATTTTT | TCAAGCCAAG | AACTCAG... | ...G | GGATATTGTG |
| AACH01000019 | TGCCCATCTT | CCAAGCTAAG | AACTCAG... | ...G | GGATATTGTG |
| AACA01000631 | TGCCAATTTT | CCAAGCCAAG | AACTCAG... | ...G | GGACATCGTC |
| AACF01000116 | TGCACATTTT | CCAAAGAAG | AACTCCG... | ...G | TGATATTGTG |
| AE016819 | TACCTATTAT | GAAAGCCAAG | AATTCCG... | ...G | GGACATTGTC |
| CR382139 | TGCCAATCAT | GAAAAGAAG | AACAGCG... | ...G | AGATGTTGTT |
| XM_001387479 | TTCCCATTTT | TAAGGCTAAA | AATTCTG... | ...G | AGATATCGTC |
| XM_001482184 | TACCCATCTT | CAAAAGAAA | AATGCTG... | ...G | AGATATTGTG |
| XM_002419771 | TACCTTTACT | TAAAAAAAAA | CCTTATG... | ...C | TGATGTGGTT |
| CR380959 | TGCCATTATT | CAAGAAGAAG | AACAGTG... | ...G | TGATATCGTC |
| XM_001645671 | TTCCAATATT | CAAGGCTAAA | AATTTCG... | ...G | TGATATCGTA |
| SAKL0H04730 | TGCCTATTTT | CAAAGCCAAG | AATTCCG... | ...G | TGACATCGTT |
| XM_451902 | TGCCCATCTT | CAAAGCCAAA | AACTCTG... | ...G | TGATATCGTG |
| XM_002553230 | TACCTATCTT | CAAAAGAAAA | AATTCTG... | ...G | TGATGTCGTT |
| XM_002494574 | TGCCCATATT | CCAAGCCAAG | AATTCAG... | ...G | AGATATTGTA |
| YMR226C | TTCCTATATT | CTACAGCAAA | AACAAGG... | ...G | TGATATTTTG |
| NM_001018495 | TCGGGCGAGAT | GCGAAAGCGA | AACAAGG... | ...G | CGACATTGTC |
| XM_501554 | TGCCCATCTT | CAAGGCCCGC | GGCTCCGAGG | GTGGTTCGGG | AGACATTGTG |
| XM_957621 | | | | | |

FIG. 12K

|  | 551 | | | | | 600 |
|---|---|---|---|---|---|---|
| AABY01000127 | AACTTGGG.T | TCGGTGGCTG | GCAGGGATGC | ATACCCAACG | GGTTCCATCT |
| AACH01000019 | AACTTGGG.C | TCGGTAGCTG | GCAGAGATGC | ATACCCAACG | GCTCCATCT |
| AACA01000631 | AACTTGGGGC | TCGGTGGCCG | GCAGAGACGC | ATACCCAACA | GCTCCATCT |
| AACF01000116 | AACTTAGG.T | TCAGTTGCTG | GAAGAGATGC | ATACCCAACA | GGGTCCATTT |
| AE016819 | AATGTTGG.G | TCGATTGCCG | GCCGCGAAGC | CTACCCTGGT | GGCTCTATTT |
| CR382139 | AATATAGG.T | TCGATTGCTG | GAAGAGACTC | TTACCCTGGA | GGTGGAATTT |
| XM_001387479 | AACATCGG.T | TCGATTGCTG | GAAGAGACCC | TTACCCTGGT | GGATCGATCT |
| XM_001482184 | AACATTGG.C | TCAGTGGCCG | GTAGAGAAAC | GTACCCTGGA | GGTGCAGTAT |
| XM_002419771 | TTCATTGG.A | AGTATTGCTG | GACGTGTTCC | TTATAAAAAT | GGAGGTGGTT |
| CR380959 | AACTTGGG.A | TCGATTGCTG | GTAGAGACGC | ATACCCAACG | GGTGCTATAT |
| XM_001645671 | AATTTAGG.G | TCAATTGCAG | GCATAGAAGC | TTACCCAACA | GGATCTATAT |
| SAKL0H04730 | AACTTGGG.G | TCTGTCGCTG | GTAGAGATGC | TTATCCAACC | GGTTCTATCT |
| XM_451902 | AACTTAGG.T | TCTGTTGCCG | GTAGAGATGC | ATATCCAACT | GGTTCTATCT |
| XM_002553230 | AACCTGGG.T | TCTGTCGCTG | GCAGAGAAGC | TTACCCTACA | GGATCTATTT |
| XM_002494574 | AACATTAG.T | TCGGTGGCTG | GTAGAGAGGC | ATACCCAGGT | GGTTCCATTT |
| YMR226C | AATTTGG.T | TCAATCGCTG | GCAGAGACGC | ATACCCAACA | GGTTCTATCT |
| NM_001018495 | AACGTTGG.C | AGTATTGCCG | GCAGAGAATC | ATACGTAGGC | GGCTCCGTTT |
| XM_501554 | AACATTGG.C | TCCATCGCCG | GACGAGAGCC | CTACGTTGGA | GGAGGAATCT |
| XM_957621 | AACATCGG.T | TCTATTGCCG | GGAGAGAACC | ATACGGGGGA | GGCTCCATCT |

FIG. 12L

|              |     |            |            |            |            |            |
|---|---|---|---|---|---|---|
|              |     | 601        |            |            |            | 650        |
| AABY01000127 |     | ATTGTGCCTC | CAAGTTTGCC | GTGGGGGCGT | TCACTGATAG | TTTAAGAAAG |
| AACH01000019 |     | ATTGTGCATC | TAAGTTTGCC | GTCGGGGCTT | TCACTGAGAG | TTTGAGAATG |
| AACA01000631 |     | ACTGTGCTTC | CAAGTTTGCC | GTCGGTGCGT | TCACTGACAG | TTTGAGAAAG |
| AACF01000116 |     | ACTGTGCTTC | TAAATTTGCC | GTGAGGGCCT | TTACTGAAAG | TTTGAGAAGG |
| AE016819     |     | ACTGTGCCAC | GAAACATGCG | GTCAAGGCTT | TCACCAGGGC | CATGCGGAAG |
| CR382139     |     | ACTGTGCCAA | TAAGGCAAGT | GTCAAGTCGT | TTTCGCAAGT | TTTGAGAAAG |
| XM_001387479 |     | ACTGTGCCTC | CAAGGCTGCT | GTTAAGTTCT | TCTCGCATTC | TTTGAGAAAG |
| XM_001482184 |     | ACTGTGCTTC | AAAGGCAGCA | GTTAACTACT | TTTCTCATTC | TTTGAGAAAG |
| XM_002419771 |     | ATTGTGCATC | TAAAGCTGCT | GTTCGTAGTT | TCACCGATAC | ATTTAGAAAA |
| CR380959     |     | ACTGTGCAAC | AAAACATGCT | GTCAAAGCAT | TCACACAATC | CTTAAGGAAG |
| XM_001645671 |     | ATTGTGCAAC | TAAATTTGCA | GTTAAAGCAT | TCACTGAAAG | TTTAAGAAAG |
| SAKL0H04730  |     | ACTGTGCTAG | CAAACATGCA | GTCAGAGCCT | TCACTCAAAG | TTTGAGGAAG |
| XM_451902    |     | ATTGTGCTTC | GAAGCATGCT | GTCAGAGCGT | TCACTCAGTC | TTTGAGAAAA |
| XM_002553230 |     | ACTGCGCTAC | GAAGCACGCG | GTGCGTGCTT | TCACCCAGAG | CCTGCGCAAG |
| XM_002494574 |     | ACTGTGCTAC | TAAACACGCT | GTTAAGGCAT | TCACTGAAAG | TTTGCGTAAG |
| YMR226C      |     | ATTGTGCCTC | TAAGTTTGCC | GTGGGGGCGT | TCACTGATAG | TTTGAGAAAG |
| NM_001018495 |     | ACTGCTCTAC | CAAGTCTGCC | CTTGCTCAAT | TCACTTCCGC | TTTGCGTAAG |
| XM_501554    |     | ACTGTGCCAC | CAAGGCCGCC | GTGCGATCTT | TCACTGAGAC | TCTCCGAAAA |
| XM_957621    |     | ACTGCGCCAC | CAAGGCTGCT | GTGCCCAGCT | TCACCGACGC | GCTGCGCAAG |

FIG. 12M

|              | 651                                                  |              |              |              | 700          |
|---|---|---|---|---|---|
| AABY01000127 | GAGCTTATCA | ACACCAAGAT | CAGAGTCATC | CTAATCGCAC | CAGGGCTAGT |
| AACH01000019 | GAACTTATAA | ACACTAAGAT | TAGAGTCATT | CTAATTGCAC | CAGGGTTAGT |
| AACA01000631 | GAACTGATCA | ACACGAAGAT | CAGAGTTATC | TTGATCGCGC | CGGGGCTGGT |
| AACF01000116 | GAATTAATTA | ATACCAAGAT | TAGGGTGATA | TTGATAGCCC | CGGGTATCGT |
| AE016819     | GAGCTCATTA | GCACCAAGAT | CCGGGTCTTC | GAAATTGCGC | CGGGTCTCGT |
| CR382139     | GAATTGATTA | GCACCAAGAA | TAGAGTTCTT | GAGGTTGACC | CTGGTAATGT |
| XM_001387479 | GAACTCATTA | ACACCAGAAT | CAGAGTTTTG | GAAGTTGATC | CAGGTGCTGT |
| XM_001482184 | GAAACTATCA | ATTCCAAAAT | CAGGGTCATG | GAGGTTGGATC | CTGGGGCAGT |
| XM_002419771 | GAAACTATTA | ATACTGGTAT | TAGAGTCATT | GAAGTTGATC | CAGGTGCAGT |
| CR380959     | GAATTGATCA | ACACCGACAT | TAGAGTAAAT | GAAATTGCTC | CTGGTATGGT |
| XM_001645671 | GAATTGATTA | ATACAAAGAT | CAGAGTTATT | GAAATTGCAC | CAGGTATGGT |
| SAKL0H04730  | GAATTGGTGA | ACACCAATAT | CAGAGTGATT | GAAATTGCTC | CGGGTAATGT |
| XM_451902    | GAATTAATCA | ATACTGGTAT | TAGGGTCATT | GAGATTGCTC | CAGGTAATGT |
| XM_002553230 | GAACTGATCA | ACACAAACAT | CAGGGTTATT | GAGGTCGCTC | CAGGTAACGT |
| XM_002494574 | GAATTAGTCG | ATACAAAAAT | CAGAGTCATG | AGTATTGATC | CTGGTAATGT |
| YMR226C      | GAGCTCATCA | ACACTAAAAT | TAGAGTCATT | CTAATTGCAC | CAGGGCTAGT |
| NM_001018495 | GAGACTATTG | ACACTCGCAT | TCGTATTATG | GAGGTTGATC | CTGGCTTGGT |
| XM_501554    | GAGAACATCG | ACACTCGAAT | CCGAGTCATT | GAGGTTGATC | CTGGAGCCGT |
| XM_957621    | GAGCTGATCG | CCACGCGCAT | CCGTGTCATG | GAGATTGACC | CTGGCCAGGT |

FIG. 12N

|              | 701                                                          | 750 |
|---|---|---|
| AABY01000127 | CGAAAACTGAA TTTTCACTGG TTAGATACAG AGGCAACGAG GAGCAAGCCA |
| AACH01000019 | CGAAAACTGAG TTTTCCCTGG TTAGATACAG AGGTAACGAA GAACAAGCCA |
| AACA01000631 | TGAGACCGAG TTCTCACTGG TCAGATACAG AGGTAATGAG GAACAAGCTA |
| AACF01000116 | CGAAAACTGAA TTCTCAGTTG TTAGATACAA GGGTGATAAT GAGCGTGCTA |
| AE016819     | AGAAACGGAA TTCTCCATGG TTCGTATGCG CGGTAACGAA GAGAATGCCA |
| CR382139     | TGAAAACTGAA TTTTCAAATG TCAGATTCAA GGGCGATATG GAAAAGGCAA |
| XM_001387479 | GTTGACCGAG TTCTCTTTGG TTCGTTTCCA CGGTGATCAG GGAGCTGCTG |
| XM_001482184 | AGAGACAGAG TTCTCGTTGG TTCGTTTTGG CGGTGATGCC GAGGCTGCGA |
| XM_002419771 | ACTTACTGAA TTTAGTGTTG TTCGTTATAA AGGTGACACT GATGCTGCCG |
| CR380959     | CGAAACCGAG TTTTCTGTGG TCAGGTACAA AGGTGACAAG TCCAAAGCAG |
| XM_001645671 | TAACACTGAA TTTTCTCTGTAA TTAGATATAA AGGTGACCAA GAAAAGGCAG |
| SAKL0H04730  | TGAAAACTGAG TTTTCCCTTAG TTAGATATAA AGGTGATACG GACCGTGCTA |
| XM_451902    | CGAAAACTGAG TTCTCTCTAG TTAGATACAA GGGTGATGCC GATCGTGCTA |
| XM_002553230 | GGAGACCGAG TTTTCTCTGG TTAGATACAA GGGCGACTCT GAGAAAGCCA |
| XM_002494574 | AGAGACCGAA TTTTCTATGG TTAGATTCCG TGGTGATACA GAAAAGGCAA |
| YMR226C      | CGAGACTGAA TTTTCACTAG TTAGATACAG AGGTAACGAG GAACAAGCCA |
| NM_001018495 | CGAAACCGAA TTCAGCGTTG TGAGATTCCA CGGAGACAAA CAAAAGGCTG |
| XM_501554    | TGAGACCGAG TTCTCCGTCG TGCGATTCCG AGGAGACAAG TCCAAGCCG |
| XM_957621    | CGAGACCGAG TTCAGCGTGG TGAGGTTCTA TGGTGATAAG AACAAGGCTG |

FIG. 12O

| | 751 | | | | 800 |
|---|---|---|---|---|---|
| AABY01000127 | AGAAATGTCTA | CAA.GGACAC | CACCCCATTA | ATGGCTGATG | ACGTGGCTGA |
| AACH01000019 | AGAAATGTTTA | CAA.GGACAC | CACTCCGTTG | ATGGCCGATG | ACGTGGCTGA |
| AACA01000631 | AAAACGTCTA | CGA.GGACAC | TACGCCGTTG | ATGGCCGACG | ACGTGGCTGA |
| AACF01000116 | AATCTGTCTA | CGATGGGAGTT | CACCCCTTGG | AAG.CAGACG | ACGTAGCAGA |
| AE016819 | AGAAAGTGTA | CCA.GGGATT | TGAACCCCTA | GATGGTGATG | ATATCGCTGA |
| CR382139 | AGCTGGTTTA | CGC.GGGTAC | TGAACCATTA | TTATCCGAAG | ACGTAGCTGA |
| XM_001387479 | ATGCTGTTTA | TGA.AGGTAC | CCAACCTTTG | GATGCCTCTG | ATATCGCAGA |
| XM_001482184 | AAAAGGTGTA | TGA.GGGAAC | CGAGCCTTTG | GGCCCAGAAG | ATATTGCGGA |
| XM_002419771 | ATGCTGTTTA | TAC.TGGTAC | TGAACCATTA | ACACCAGAAG | ATGTTGCTGA |
| CR380959 | ACGACGTCTA | CAG.AGGTAC | AACACCACTA | TATGCCGATG | ATATCGCGGA |
| XM_001645671 | ATAAAGTTTTA | TGA.AAAACAC | TACTCCTTTA | TATGCAGATG | ACATCGCTGA |
| SAKL0H04730 | AAAAGGTTTA | TGA.AGGTAC | TAACCCATTA | TATGCAGATG | ACATTGCTGA |
| XM_451902 | AACAGGTTTA | CAA.AGGTAC | TACTCCTCTA | TATGCAGATG | ACATTGCTGA |
| XM_002553230 | AGAAGGTTTA | CGA.AGGCAC | ACAACCCCTT | TACGCTGACG | ATATCGCAGA |
| XM_002494574 | AGAAGGTTTA | CCA.AGACAC | TGTCCCATTA | TATGCAGATG | ACATTGCAGA |
| YMR226C | AGAATGTTTA | CAA.GGATAC | TACCCCATTG | ATGGCTGATG | ACGTGGCTGA |
| NM_001018495 | ATAATGTTTA | CAA.AAATAG | TGAGCCTTTG | ACACCCGAAG | ACATTGCTGA |
| XM_501554 | ACGCTGTTTA | CGC.TGGAAC | CGAGCCTCTG | GTCGCTGACG | ATATTGCCGA |
| XM_957621 | ATGCCGTCTA | TGC.CGGTGT | CGATCCCTTG | ACGCCCGATG | ATATCGCAGA |

FIG. 12P

|          | 801 |  |  |  |  | 850 |
|---|---|---|---|---|---|---|
| AABY01000127 | TTTGATCGTG | TACGCAACTT | CCAGGAAACA | AAACACTGTA | ATTGCAGACA |
| AACH01000019 | TTTGATTGTG | TATGCGACTT | CAAGGAAAGCA | GAACACTGTA | ATTGCAGACA |
| AACA01000631 | CTTAATCGTA | TATTCCACTT | CCAGAAAAGCA | GAACACCGTG | GTTGCCGACA |
| AACF01000116 | TTTAATTGTA | TACACCACTT | CAAGAAAAACA | GAACACAGTA | ATTGCTGACA |
| AE016819 | TACAATTGTC | TATGCCACAT | CCAGAAGATC | CAACACCGTA | GTTGCAGAGA |
| CR382139 | GGTTGTCGTA | TTCGGACTTA | CAAGAAAGCA | AAATACCGTT | ATTGCTGAGA |
| XM_001387479 | AGTTATCGTG | TTTGGTATCA | CCAGAAAGCA | GAACACCGTC | ATAGCCGAAA |
| XM_001482184 | AATCATTGTG | TTTGCTGTGT | CGAGAAAAGCA | CAAAACTGTC | ATTGCGGAAA |
| XM_002419771 | AGTGGTTGTT | TTTGCATCTT | CAAGAAAACA | AAATACCGTT | ATTGCTGATA |
| CR380959 | TTTGATTGTG | TACTCTACCA | GCAGAAAGCC | AAACATGGTG | GTAGCAGATG |
| XM_001645671 | TTTGATAGTT | TACACCACTT | CTAGAAAATC | GAATACCGTT | ATCGCTGATG |
| SAKL0H04730 | CCTTATTGTG | TATGCTACTT | CTAGAAAGCA | TAATACTGTC | ATTGCGGATG |
| XM_451902 | CTTGATCGTT | TATGCCACCT | CAAGAAAACC | TAATACCGTC | ATCGCTGATG |
| XM_002553230 | CCTAATCGTT | TACGCAACCT | CGAGAAAGCA | AAACACCGTC | ATCGCGGACG |
| XM_002494574 | TTTAATCGTC | TATGCAACCT | CTAGAAAGCA | AAACACTGTC | ATTGCTGACA |
| YMR226C | TCTGATCGTC | TATGCAACTT | CCAGAAAAACA | AAATACTGTA | ATTGCAGACA |
| NM_001018495 | GGTGATTCTT | TTTGCCCTCA | CTCGCAGAGA | AAACGTCGTT | ATTGCCGATA |
| XM_501554 | GTTCATCACC | TACACTCTCA | CTCGACGAGA | GAATGTCGTC | ATTGCCGATA |
| XM_957621 | GATCGTTGGTG | TTCGTCGTAA | CACGACGGGA | GAACGTTGTT | GTTGCTGATA |

FIG. 12Q

|               | 851                                                              | 900 |
|---------------|------------------------------------------------------------------|-----|
| AABY01000127  | CGCTAATCTT TCCAACCAAC CAAGCATCGC CTCACCACAT CTTCCGTGGA |
| AACH01000019  | CACTAATCTT TCCTACCAAC CAAGCGTCAC CTTACCATAT CTTTCGCGGG |
| AACA01000631  | CCCTGATCTT CCCCACCAAC CAAGCCTCGC CCTACCACAT CTTTCGCGGT |
| AACF01000116  | CTTTGATATT CCCAACCTCT CAAGGTTCCG CATTCCACGT CCATCGCGAT |
| AE016819      | TGGTCGTTTA CCCATCCGCG CAAGGTTCTC TGTACGATAC TCACCGCAAC |
| CR382139      | CATTAGTCTT TTCAACCAAT CAAGCCAGCT CATCTCACTT ATACCGTGAA |
| XM_001387479  | CCTTGGTATT CCCAAGTCAC CAGGCTTCTG CCTCTCATGT TTACAAGGCT |
| XM_001482184  | CTTTGGTGTT TCCTACCCAT CAGGCTGGAG CAGTTCATGT TCATAGAGGG |
| XM_002419771  | CTTTGATTTT CCCAAATCAT CAAGCTTCTC CAGATCATGT TTATAGAAAA |
| CR380959      | TCCTGGTCTT CCCAACACAC CAGGCATCGG CTTCGCACAT CTACAGGGGC |
| XM_001645671  | TTTTGGTATT CCCAACATGC CAAGCTTCTG CATCCCATAT CTATCGTGGA |
| SAKL0H04730   | TTTTGGTTTT TGCTTCAAAC CAAGCATCCC CTTACCATCC CTATCGCGGT |
| XM_451902     | TTTTGGTATT TGCTTCCAAC CAGGCATCTC CTTACCACAT TTACCGTGGC |
| XM_002553230  | TTTTGGTTTT CGCTTCGAAC CAGGCTTCGC CTTACCACAT TTACCGTGGT |
| XM_002494574  | CTTTGATCTT CTCTTCTAAC CAGGCATCAC CATACCACCT CTACAGAGGC |
| YMR226C       | CTTTAATCTT TCCAACAAAC CAAGCGTCAC CTCATCATAT CTTCCGTGGA |
| NM_001018495  | CACTTGTTTT CCCATCCCAT CAAGGTGGTG CCAATCATGT GTACAGAAAG |
| XM_501554     | CTCTCATTTT CCCAACCAC CAGGCTTCTC CTACTCACGT CTACCGAAAG |
| XM_957621     | CGTTGGTCTT CCCTAGCCAT CAGGCTGGCG CTGGTATTAT GCACCGCAAG |

FIG. 12R

|  | 901 | 921 | |
|---|---|---|---|
| AABY01000127 | TGA......... | ............ | (SEQ ID NO:41) |
| AACH01000019 | TGA......... | ............ | (SEQ ID NO:47) |
| AACA01000631 | TAA......... | ............ | (SEQ ID NO:43) |
| AACF01000116 | TAA......... | ............ | (SEQ ID NO:45) |
| AE016819 | TAA......... | ............ | (SEQ ID NO:49) |
| CR382139 | AGCGATAAAT AA | ............ | (SEQ ID NO:53) |
| XM_001387479 | CCTAAGTAG... | ............ | (SEQ ID NO:55) |
| XM_001482184 | CCGCTTGAGT GA | ............ | (SEQ ID NO:57) |
| XM_002419771 | CCTAATTAA... | ............ | (SEQ ID NO:61) |
| CR380959 | GACTAA...... | ............ | (SEQ ID NO:51) |
| XM_001645671 | TAA......... | ............ | (SEQ ID NO:59) |
| SAKL0H04730 | GACTAA...... | ............ | (SEQ ID NO:69) |
| XM_451902 | GAATAG...... | ............ | (SEQ ID NO:67) |
| XM_002553230 | TAG......... | ............ | (SEQ ID NO:65) |
| XM_002494574 | TCTCAAGACA AAACCAATTG | A | (SEQ ID NO:63) |
| YMR226C | TAA......... | ............ | (SEQ ID NO:24) |
| NM_001018495 | CAAGCGTAG... | ............ | (SEQ ID NO:73) |
| XM_501554 | AACTGA...... | ............ | (SEQ ID NO:71) |
| XM_957621 | TCGACATGA... | ............ | (SEQ ID NO:75) |

FIG. 12S

HOST CELLS AND METHODS FOR PRODUCTION OF ISOBUTANOL

CROSS-REFERENCE TO RELATED APPLICATIONS

This application is a continuation of U.S. patent application Ser. No. 13/428,585 (filed Mar. 23, 2012 which claims priority under 35 U.S.C. §119(e) to U.S. Application Nos. 61/472,484 (filed Apr. 6, 2011), 61/467,261 (filed Mar. 24, 2011), 61/472,487 (filed Apr. 6, 2011), 61/467,271 (filed Mar. 24, 2011), 61/570,513 (filed Dec. 14, 2011), 61/467,249 (filed Mar. 24, 2011), 61/472,497 (filed Apr. 6, 2011), and 61/472,474 (filed Apr. 6, 2011), each of which is in incorporated herein by reference in its entirety.

GOVERNMENT LICENSE RIGHTS

This invention was made with Government support under Agreement DE-AR0000006 awarded by the United States Department of Energy. The Government has certain rights in this invention.

FIELD OF THE INVENTION

The invention relates to recombinant host cells and methods for fermentative production of isobutanol.

REFERENCE TO SEQUENCE LISTING SUBMITTED ELECTRONICALLY VIA EFS-WEB

The content of the electronically submitted Sequence Listing (Name: 20120323_CL5367USNA_SEQLIST.txt; Size 2,003,893 bytes; Date of Creation Mar. 23, 2012) is herein incorporated by reference in its entirety.

BACKGROUND OF THE INVENTION

Butanol is an important industrial chemical, useful as a fuel additive, as a feedstock chemical in the plastics industry, and as a food grade extractant in the food and flavor industry. Each year 10 to 12 billion pounds of butanol are produced by petrochemical means and the need for this commodity chemical will likely increase in the future.

Methods for the chemical synthesis of isobutanol are known, such as oxo synthesis, catalytic hydrogenation of carbon monoxide (Ullmann's Encyclopedia of Industrial Chemistry, 6th edition, 2003, Wiley-VCH Verlag GmbH and Co., Weinheim, Germany, Vol. 5, pp. 716-719) and Guerbet condensation of methanol with n-propanol (Carlini et al., J. Molec. Catal. A. Chem. 220:215-220, 2004). These processes use starting materials derived from petrochemicals, are generally expensive, and are not environmentally friendly. The production of isobutanol from plant-derived raw materials would minimize green house gas emissions and would represent an advance in the art.

Isobutanol is produced biologically as a by-product of yeast fermentation. It is a component of "fusel oil" that forms as a result of the incomplete metabolism of amino acids by fungi. Isobutanol is specifically produced from catabolism of L-valine. After the amine group of L-valine is harvested as a nitrogen source, the resulting α-keto acid is decarboxylated and reduced to isobutanol by enzymes of the so-called Ehrlich pathway (Dickinson et al., J. Biol. Chem. 273:25752-25756, 1998).

Improvements and alternatives for the biosynthesis of butanol directly from sugars would improve economic viability and would represent an advance in the art.

SUMMARY OF THE INVENTION

Provided herein are recombinant yeast host cells and methods for the production of isobutanol.

In some embodiments, a recombinant host cell comprises an engineered isobutanol production pathway and (a) at least one of (i) a heterologous polypeptide with ketol-acid reductoisomerase (KARI) activity selected from the group consisting of (1) a polypeptide having at least about 90% identity to a KARI enzyme derived from *Bifidobacterium angulatum, Bifidobacterium dentium, Zymomonas mobilis, Clostridium beijerinckii* or *Anaerostipes caccae*, or an active fragment thereof (2) a polypeptide having at least about 90% identity or at least about 95% identity to SEQ ID NO: 27, 29, 31, 33, 35, 37, 39, 41, 43, 45, 47, 49, 51, 53, 55, 57, 59, 61, 63, or 65; or (ii) a heterologous polynucleotide encoding the heterologous polypeptide with KARI activity of (a); and (b) at least one host cell modification that enhances performance of the engineered isobutanol production pathway. In some embodiments, the combination of (a) and (b) results is a synergistic increase in isobutanol production pathway performance.

In some embodiments, a recombinant host cell comprises an isobutanol biosynthetic pathway and (a) a heterologous polypeptide with ketol-acid reductoisomerase (KARI) activity selected from the group consisting of (i) a polypeptide having at least about 90% identity to a KARI enzyme derived from *Bifidobacterium angulatum, Bifidobacterium dentium, Zymomonas mobilis, Clostridium beijerinckii* or *Anaerostipes caccae*, or an active fragment thereof, (ii) a polypeptide having at least about 90% identity or at least about 95% identity to SEQ ID NO: 27, 29, 31, 33, 35, 37, 39, 41, 43, 45, 47, 49, 51, 53, 55, 57, 59, 61, 63, or 65, (iii) a polypeptide having at least about 90% identity or at least about 95% identity to a KARI enzyme derived from *Bifidobacterium angulatum, Bifidobacterium dentium, Enterococcus gallinarum, Streptococcus thermophiles, Zymomonas mobilis, Clostridium beijerinckii, Anaerostipes caccae*, or *Lactococcus lactis* subsp. *cremoris* MG1363 or an active fragment thereof, wherein the polypeptide has a $K_M$ for NADH less than about 50, (iv) a polypeptide having at least about 90% identity or at least about 95% identity to a KARI enzyme derived from *Staphylococcus capitis* SK14, *Staphylococcus epidermidis* M23864-W1, *Staphylococcus hominis* SK119, *Staphylococcus aureus* subsp. *aureus* TCH130, *Staphylococcus warneri* L37603, *Staphylococcus epidermidis* W23144, *Staphylococcus saprophyticus* subsp. *Saprophyticus* ATCC15305, *Staphylococcus carnosus* subsp. *Carnosus* TM300, *Listeria monocytogenes* EGO-e, *Listeria grayi* DSM 20601, *Enterococcus casseliflavus* EC30, *Enterococcus gallinarum* EG2, *Macrococcus caseolyticus* JCSC5402, *Streptococcus vestibularis, Streptococcus mutans* UA159, *Streptococcus gordonii* str, cgakkus sybstr. CH1, *Streptococcus suis* 89/1591, *Streptococcus infantarius* subsp. *infantarius* ATCC BAA-102, *Lactococcus lactis* subsp *cremoris* MG1363, *Lactococcus lactis, Leuconostoc mesenteroides* subsp *mesenteroides* ATCC8293, *Lactobacillus buchneri* ATCC 11577, *Staphylococcus haemolyticus* JCSC1435, *Staphylococcus epidermidis* ATCC12228, *Streptococcus pneumoniae* CGSP14, *Streptococcus pneumoniae* TIGR4, *Streptococcus sanguinis* SK36, *Streptococcus salivarius* SK126, *Streptococcus thermophilus* LMD-9, *Streptococcus pneumoniae* CCRI 1974M2, *Lactococcus lactis* subsp. *lactis* 111403, *Leuconostoc mesenteroides* subsp *cremoris* ATCC19254,

*Leuconostoc mesenteroides* subsp *cremoris*, *Lactobacillus brevis* subsp. *gravesensis* ATCC27305, or *Lactococcus lactis* subsp *lactis* NCDO2118 or an active fragment thereof, wherein the heterologous polypeptide has a $K_M$ for NADH less than about 50, (v) a heterologous polypeptide with KARI activity having at least about 90% identity or at least about 95% identity to SEQ ID NO: 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, or 135 or an active fragment thereof, wherein the heterologous polypeptide has a $K_M$ for NADH less than about 50; (b) a heterologous polynucleotide encoding the heterologous polypeptide with KARI activity of (a); (c) reduced or eliminated aldehyde dehydrogenase activity; (d) reduced or eliminated aldehyde oxidase activity; (e) reduced or eliminated acetolactate reductase activity; or (f) a combination thereof.

In one embodiment, the recombinant host cell comprises reduced or eliminated aldehyde dehydrogenase expression activity and reduced or eliminated acetolactate reductase expression or activity.

In another embodiment, the recombinant host cell comprises (i) reduced or eliminated aldehyde dehydrogenase expression or activity or reduced or eliminated acetolactate reductase expression or activity and (ii) a heterologous polynucleotide encoding a polypeptide having KARI activity and $K_M$ for NADH less than 300 μM.

In another embodiment, the recombinant host comprises a heterologous polypeptide with KARI activity that has at least about 90% or at least about 95% identity to SEQ ID NO: 27, 29, 141, 143, 275, or 277.

In some embodiments, the recombinant host cell comprises a heterologous polypeptide with KARI activity that comprises substitutions in amino acids corresponding to S56 and S58 of SEQ ID NO: 27. In some embodiments, the polypeptide with KARI activity further comprises a substitution of one or more of the amino acids corresponding to I86, N87, T131, or T191 of SEQ ID NO: 27. In some embodiments, the polypeptide with KARI activity having at least 90% identity or at least 95% identity to SEQ ID NO: 31, 33, 35, 37, 39, 41, 43, 45, 47, 49, 51, 53, 55, 57, 59, 61, 63, or 65.

In some embodiments, the recombinant host cell has an effective isobutanol productivity of at least about 3, at least about 4, or at least about 5 grams per gram of cells after about 48 hours, wherein at least the last about 24 of the 48 hours are under anaerobic conditions.

In some embodiments, the recombinant host cell comprises a heterologous polypeptide with KARI activity that has a $K_M$ for NADH less than about 350, less than about 100, less than about 50, or less than about 10 μm at pH 6.8.

In some embodiments, the recombinant host cell comprises a heterologous polypeptide with KARI activity that has at least about 90% identity or at least about 95% identity to SEQ ID NO: 376, 382, 378, or 275.

In some embodiments, the recombinant host cell comprises a heterologous polypeptide with KARI activity comprises an amino acid substitution at one or more of the positions corresponding to amino acids A41, S56, S58, I87, T131, T191, R227, or Q246 of a KARI enzyme derived from *Anaerostipes caccae* (SEQ ID NO:27).

In some embodiments, the recombinant host cell comprises a heterologous polypeptide with KARI activity that comprises SEQ ID NO: 33 or SEQ ID NO:35 or an active fragment thereof.

In another embodiment, the recombinant host cell comprises a deletion, mutation, and/or substitution in an endogenous polynucleotide encoding a polypeptide having aldehyde dehydrogenase activity. In some embodiments, the polypeptide having aldehyde dehydrogenase activity catalyzes the conversion of isobutyraldehyde to isobutyric acid. In some embodiments, the polypeptide having aldehyde dehydrogenase activity corresponds to Enzyme Commission Number EC 1.21.3, EC 1.2.1.4, and/or EC1.2.1.5. In some embodiments, the host cell is *S. cerevisiae* and the polypeptide having aldehyde dehydrogenase activity is ALD2, ALD3, ALD4, ALD5, ALD6 or a homolog thereof. In some embodiments, the host cell is *K. lactis* and the polypeptide having aldehyde dehydrogenase activity is KLLA0F00440, KLLA0E23057, KLLA0D10021, or KLLA0D09999G. In some embodiments, the host cell is *P. stipitis* and the polypeptide having aldehyde dehydrogenase activity is ALD2, ALD3, ALD4, ALD5, or ALD7. In some embodiments, the host cell is *Lactobacillus plantarum* and said polypeptide having aldehyde dehydrogenase activity is AldH. In some embodiments, the host cell is *E. coli* and the polypeptide having aldehyde dehydrogenase activity is aldA, aldB, or aldH.

In another embodiment, the host cell comprises a deletion, mutation, and/or substitution in an endogenous polynucleotide encoding a polypeptide having aldehyde oxidase activity. In some embodiments, the polypeptide having aldehyde oxidase activity catalyzes the conversion of isobutyraldehyde to isobutyric acid. In some embodiments, the polypeptide having aldehyde oxidase activity corresponds to Enzyme Commission Number EC 1.2.3.1. In some embodiments, the polypeptide having aldehyde oxidase activity is AOX1 and/or AOX2.

In another embodiment, the host cell comprises a deletion, mutation, and/or substitution in an endogenous polynucleotide encoding a polypeptide having acetolactate reductase activity. In some embodiments, the polypeptide having acetolactate reductase activity comprises a polypeptide encoded by a polynucleotide selected from the group consisting of SEQ ID NO: 676, SEQ ID NO: 678, SEQ ID NO: 680, SEQ ID NO: 682, SEQ ID NO: 684, SEQ ID NO: 686, SEQ ID NO: 688, SEQ ID NO: 690, SEQ ID NO: 692, SEQ ID NO: 694, SEQ ID NO: 696, SEQ ID NO:702, SEQ ID NO: 704, SEQ ID NO: 706, SEQ ID NO: 708, SEQ ID NO: 710, SEQ ID NO: 712, SEQ ID NO: 714, SEQ ID NO: 716, SEQ ID NO: 718, SEQ ID NO: 720, SEQ ID NO: 722, SEQ ID NO: 724, SEQ ID NO:726, SEQ ID NO:728, and SEQ ID NO: 730. In some embodiments, the polypeptide having acetolactate reductase activity is YMR226C.

In another embodiment, the recombinant host cell is a yeast host cell. In some embodiments, the yeast is selected from the group consisting of *Saccharomyces*, *Schizosaccharomyces*, *Hansenula*, *Candida*, *Kluyveromyces*, *Yarrowia*, *Issatchenkia*, or *Pichia*. In some embodiments, the host cell is *Saccharomyces cerevisiae*.

In another embodiment, the host cell is a bacterial cell. In some embodiments, the bacterial cell is a *Clostridium*, *Zymomonas*, *Escherichia*, *Salmonella*, *Rhodococcus*, *Pseudomonas*, *Bacillus*, *Lactobacillus*, *Enterococcus*, *Pediococcus*, *Alcaligenes*, *Klebsiella*, *Paenibacillus*, *Arthrobacter*, *Corynebacterium*, *Brevibacterium*, *Lactococcus*, *Leuconostoc*, *Oenococcus*, *Pediococcus*, or *Streptococcus* cell. In some embodiment, the bacterial cell is not *E. coli*.

In some embodiments, the engineered isobutanol production pathway of the recombinant host cell comprises the following substrate to product conversions: (a) pyruvate to acetolactate, (b) acetolactate to 2,3-dihydroxyisovalerate, (c) 2,3-dihydroxyisovalerate to 2-ketoisovalerate, (d) 2-ketoisovalerate to isobutyraldehyde, and (e) isobutyraldehyde to isobutanol and more than one of the substrate to product conversions is catalyzed by an enzyme that is heterologous to the host cell. In some embodiments, all of the substrate to product conversions are catalyzed by enzymes heterologous to the host cell. In some embodiments, at least one heterologous polynucleotide encoding an enzyme heterologous to the host cell is chromosomally integrated into the host cell. In some embodiments, the substrate to product conversions are catalyzed by enzymes substantially localized to the cytosol. In some embodiments, the substrate to product conversion for isobutyraldehyde to isobutanol is catalyzed by an alcohol dehydrogenase enzyme that utilizes NADH as a cofactor. In some embodiments, the conversion of acetolactate to 2,3-dihydroxyisovalerate is catalyzed by a KARI that can use NADH as a cofactor.

In some embodiments, the host cell comprises the plasmid pLH702 or pLH701 or a plasmid having the same coding regions. In some embodiments, the host cell comprises the plasmid pBP915 or a plasmid having the same coding regions. In some embodiments, the host cell comprises the plasmid pYZ067ΔkivDΔhADH or a plasmid having the same coding regions.

In some embodiments, the host cell comprises reduced, disrupted, or eliminated ability to convert acetolactate to 2,3-dihydroxy-2-methylbutyrate.

In some embodiments, the host cell is yeast and has reduced or eliminated pyruvate decarboxylase expression or activity. In some embodiments, the host cell has reduced or eliminated PDC1, PDC5, or PDC6 activity or a combination thereof.

In some embodiments, the host cell has reduced or eliminated NAD-dependent glycerol-3-phosphate dehydrogenase expression or activity. In some embodiments, the host cell has reduced GPD2 activity.

In some embodiments, the host cell has reduced or eliminated FRA2 expression or activity.

In some embodiments, the host cell produces isobutanol under anaerobic conditions and the molar ratio of isobutanol to glycerol is greater than 1.

In some embodiments, the polypeptide having ketol-acid reductoisomerase activity matches the profile HMM given provided in Table Z with a profile HMM E value of $<10^{-3}$.

In some embodiments, the host cell produces isobutanol at a yield greater than about 25%, about 50%, about 75%, or about 90% of theoretical yield.

In some embodiments, isobutanol and ethanol are produced.

Methods for producing isobutanol include methods comprising providing a recombinant host cell as described above and contacting the host cell with a carbon substrate under conditions whereby isobutanol is produced. In some embodiments, at least a portion of the contacting occurs under anaerobic conditions. In some embodiments, the contacting occurs in the presence of an extractant. In some embodiments, the contacting occurs in the presence of a sufficient quantity of organic extractant to form a two-phase system comprising an aqueous phase and an organic phase. In some embodiments, one or more of the effective rate, effective titer, or effective yield of isobutanol is increased as compared to methods using a recombinant host cell that does not comprise a heterologous polypeptide with KARI activity, a heterologous polynucleotide encoding a polypeptide with KARI activity, reduced or eliminated aldehyde dehydrogenase activity, reduced or eliminated aldehyde oxidase activity, reduced or eliminated acetolactate reductase activity, or a combination thereof. In some embodiments, one or more of the effective rate, effective titer, or effective yield of isobutanol is increased as compared to methods using a recombinant host cell that does not comprise (i) a heterologous polypeptide with KARI activity or a heterologous polynucleotide encoding a polypeptide with KARI activity and (ii) at least one modification that enhances performance of the engineered isobutanol production pathway. In some embodiments, DHMB production, isobutyric acid production, or both is reduced as compared to methods using a recombinant host cell that does not comprise a heterologous polypeptide with KARI activity, a heterologous polynucleotide encoding a polypeptide with KARI activity, reduced or eliminated aldehyde dehydrogenase activity, reduced or eliminated aldehyde oxidase activity, reduced or eliminated acetolactate reductase activity, or a combination thereof. In some embodiments, DHMB production, isobutyric acid production, or both is reduced as compared to methods using a recombinant host cell that does not comprise (i) a heterologous polypeptide with KARI activity or a heterologous polynucleotide encoding a polypeptide with KARI activity and (ii) at least one modification that enhances performance of the engineered isobutanol production pathway. In some embodiments, the molar ratio of isobutanol to glycerol is greater than 1.

Methods for producing isobutanol also comprise providing a recombinant host cell that produces isobutanol and contacting the host cell with a carbon substrate under conditions whereby isobutanol is produced, wherein at least a portion of the contacting occurs under anaerobic conditions, and wherein the ratio of isobutanol to glycerol produced is greater than 1.

Methods for producing isobutanol also comprise growing a recombinant yeast comprising a biosynthetic pathway capable of converting pyruvate to acetolactate under conditions whereby butanol is produced and removing DHMB from the culture.

Compositions produced by such methods are also provided herein. In some embodiments, the composition comprises isobutanol and a recombinant host cell provided above. In some embodiments, the composition comprises butanol and no more than about 0.5 mM DHMB.

Fermentative compositions are also provided herein. In some embodiments, a fermentative composition comprises the host cell and isobutanol produced according to the methods provided above.

Compositions comprising i) a recombinant yeast capable of producing butanol, ii) butanol, and iii) no more than about 0.5 mM DHMB are also provided.

Methods for producing a recombinant host cell are also provided. Such methods can comprise (a) providing a recombinant host cell comprising a modification in a polynucleotide encoding a polypeptide having aldehyde dehydrogenase activity or aldehyde oxidase activity; and (b) transforming the host cell with a polynucleotide encoding a polypeptide of an isobutanol biosynthetic pathway.

Methods for reducing or eliminating the conversion of isbutyraldehye to isobutyric acid are also provided. Such methods can comprise (a) providing the recombinant host cell of any one of claims 1-52; and (b) subjecting the host cell to conditions wherein the conversion of isbutyraldehye to isobutyric acid is reduced or eliminated compared to methods using a recombinant host cell that does not comprise reduced or eliminated aldehyde dehydrogenase and/or aldehyde oxidase activity.

Certain polypeptides are also provided herein. In some embodiments, the polypeptides comprise at least about 90% identity or at least about 95% identity or at least about 99% identity to SEQ ID NO: 29, 31, 33, 35, 37, 39, 41, 43, 45, 47, 49, 51, 53, 55, 57, 59, 61, 63, 65, 417, 419, 421, 423, 425, 427, 429, 431, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 624, 626, 628, 630, 632 or an active fragment thereof and have ketol-acid reductoisomerase activity. In some embodiments, the polypeptides comprise at least about 90% identity or at least about 95% identity or at least about 99% identity to SEQ ID NO: 417, 419, 421, 423, 425, or 427 or an active fragment thereof and have ketol-acid reductoisomerase activity. In some embodiments, a polypeptide comprises a sequence with at least about 90% identity, at least about 95% identity, or at least about 99% identity to SEQ ID NO: 927, 928, 196, 266, 267, 389, 405, 637, 781, 782, 783, 835, 853, 854, 855, 856, 857, or 859.

Polynucleotides encoding such polypeptides and host cells comprising such polynucleotides and polypeptides are also provided.

Methods of converting acetolactate to 2,3-dihydroxyisovalerate are also provided. For example, such methods can comprise (a) providing a polypeptide described above, and (b) contacting the polypeptide with acetolactate under conditions wherein 2,3-dihydroxyisovalerate is produced.

Recombinant yeast cells are also provided herein. In some embodiments, a recombinant yeast comprises a biosynthetic pathway capable of converting pyruvate to acetolactate, and the yeast produces less than 0.01 moles 2,3-dihydroxy-2-methyl butyrate (DHMB) per mole of sugar consumed. In some embodiments, a recombinant yeast comprises capable of converting pyruvate to acetolactate, and the yeast produces DHMB at a rate of less than about 1.0 mM/hour. In some embodiments, a recombinant yeast comprises a biosynthetic pathway capable of converting pyruvate to acetolactate, and the yeast produces an amount of 2,3-dihydroxy-3-isovalerate (DHIV) that is at least about 1.5 times the amount of DHMB produced.

Methods of identifying a gene involved in DHMB production are also provided. In some embodiments, the methods comprise (i) providing a collection of yeast strains comprising at least two or more gene deletions; (ii) measuring the amount of DHMB produced by individual yeast strains; (iii) selecting a yeast strain that produces no more than about 1.0 mM DHMB/hour; and (iv) identifying the gene that is deleted in the selected yeast strain. In some embodiments, the methods comprise (i) providing a collection of yeast strains that over-express at least two or more genes; (ii) measuring the amount of DHMB produced by individual yeast strains; (iii) selecting a yeast strain that produces at least about 1.0 mM DHMB; and (iv) identifying the gene that is over-expressed in the selected yeast strain.

Methods for the production of butanol are also provided. In some embodiments, the methods comprise (a) growing a recombinant yeast comprising a biosynthetic pathway capable of converting pyruvate to acetolactate under conditions whereby butanol is produced; and b) measuring DHIV and/or DHMB concentration. In some embodiments, the growing and measuring can be performed simultaneously or sequentially and in any order. In some embodiments, the measuring comprises liquid chromatography-mass spectrometry.

Methods for increasing ketol-acid reductoisomerase (KARI) activity are also provided. In some embodiments, the methods comprise (a) providing a composition comprising acetolactate, a KARI enzyme, and an acetolactate reductase enzyme and (b) decreasing DHMB levels. In some embodiments, decreasing DHMB levels is achieved by decreasing acetolactate reductase enzyme activity. In some embodiments, decreasing DHMB levels is achieved by removing DHMB from the composition.

In some embodiments, increasing KARI enzyme productivity in a host cell can comprises culturing a host cell, wherein the host cell comprises a heterologous KARI enzyme and at least one genetic modification that reduces, disrupts, or eliminates acetolactate reductase expression or activity, and wherein the KARI enzyme activity is decreased in the presence of DHMB. In some embodiments, the KARI has at least about 90%, at least about 95%, or at least about 99% identity to *E. coli* or *L. lactis* KARI. In some embodiments, the reduced, disrupted, or eliminated acetolactate reductase expression or activity substantially reduces the presence of DHMB.

Methods for increasing dihydroxyacid dehydratase (DHAD) activity are also provided. In some embodiments, the methods comprise (a) providing a composition comprising dihydroxyisovalerate (DHIV) and a DHAD enzyme and (b) decreasing DHMB levels.

BRIEF DESCRIPTION OF THE FIGURES AND INCORPORATION BY REFERENCE OF THE TABLE FILED ELECTRONICALLY HEREWITH

The invention can be more fully understood from the following detailed description, the Figures, and the accompanying sequence descriptions, which form part of this application.

FIG. 1—Shows four different isobutanol biosynthetic pathways. The steps labeled "a", "b", "c", "d", "e", "f", "g", "h" "i", "j" and "k" represent the substrate to product conversions described below.

FIG. 2 depicts an alignment of the amino acid sequences of the KARI from *Pseudomonas fluorescens* ("PF5"; SEQ ID NO: 5) and KARI from *Anaerostipes caccae* ("K9"; SEQ ID NO: 27). The bolded positions are targeted for mutagenesis as described herein.

FIGS. 3A, 3B and 3C depict an alignment of the amino acid sequences of KARI enzymes from *Bifidobacterium angulatum* DSM 20098 ("K1"; SEQ ID NO: 141), *Bifidobacterium dentium* ATCC 27678 ("K2"; SEQ ID NO: 143), *Clostridium beijerinckii* NCIMB 8052 ("K7"; SEQ ID NO: 275), *Anaerostipes caccae* DSM 14662 ("K9"; SEQ ID NO: 27), *Enterococcus gallinarum* EG2 ("K25" SEQ ID NO: 376), *Streptococcus thermophilus* LIVID-9 ("K26" SEQ ID NO: 121), *Lactococcus lactis* subsp. *cremoris* MG1363 ("K29"; SEQ ID NO: 382), *Zymomonas mobilis* ("S2": SEQ ID NO: 277), and *Lactococcus lactis* ("LTS"; SEQ ID NO: 380). The bolded positions are targeted for mutagenesis as described herein.

Figure 9A:
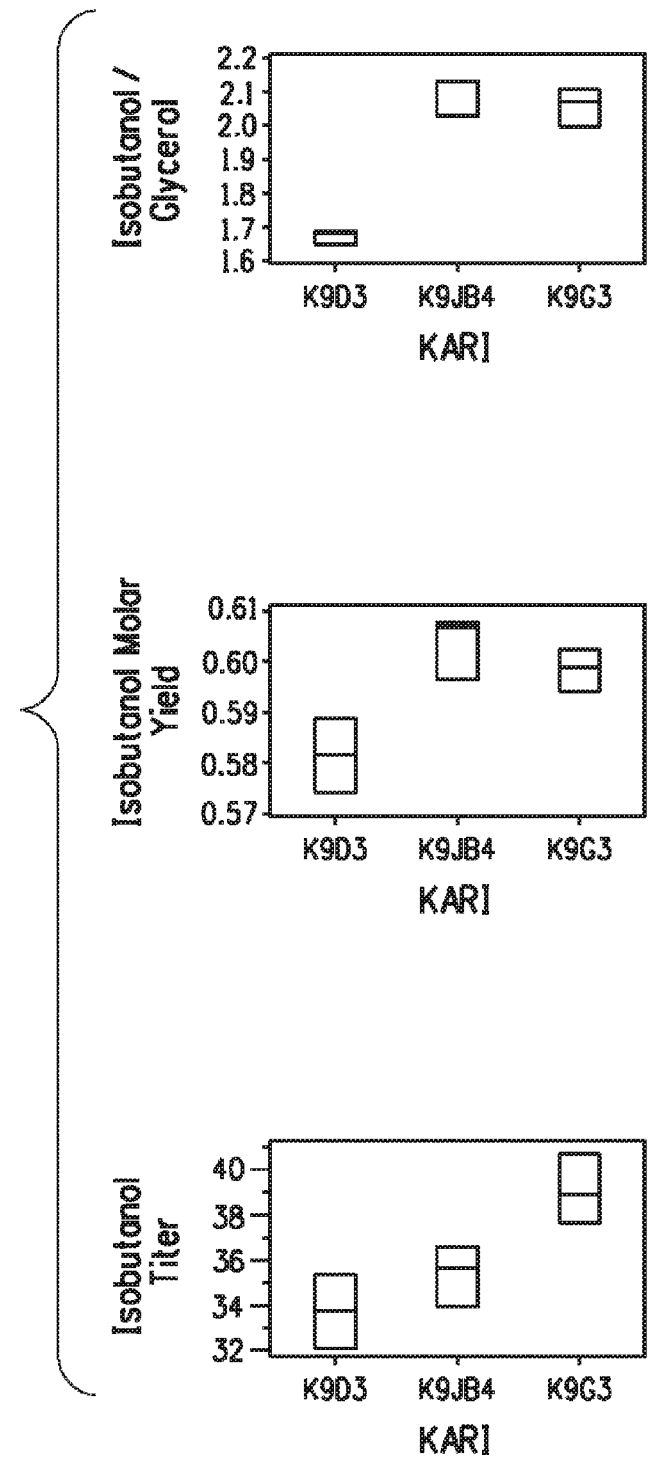

FIGS. 9A, B, and C show isobutanol to glycerol molar yield ratios, isobutanol molar yields, and isobutanol titers for K9 variants as described in Example 19.

Figure 10:
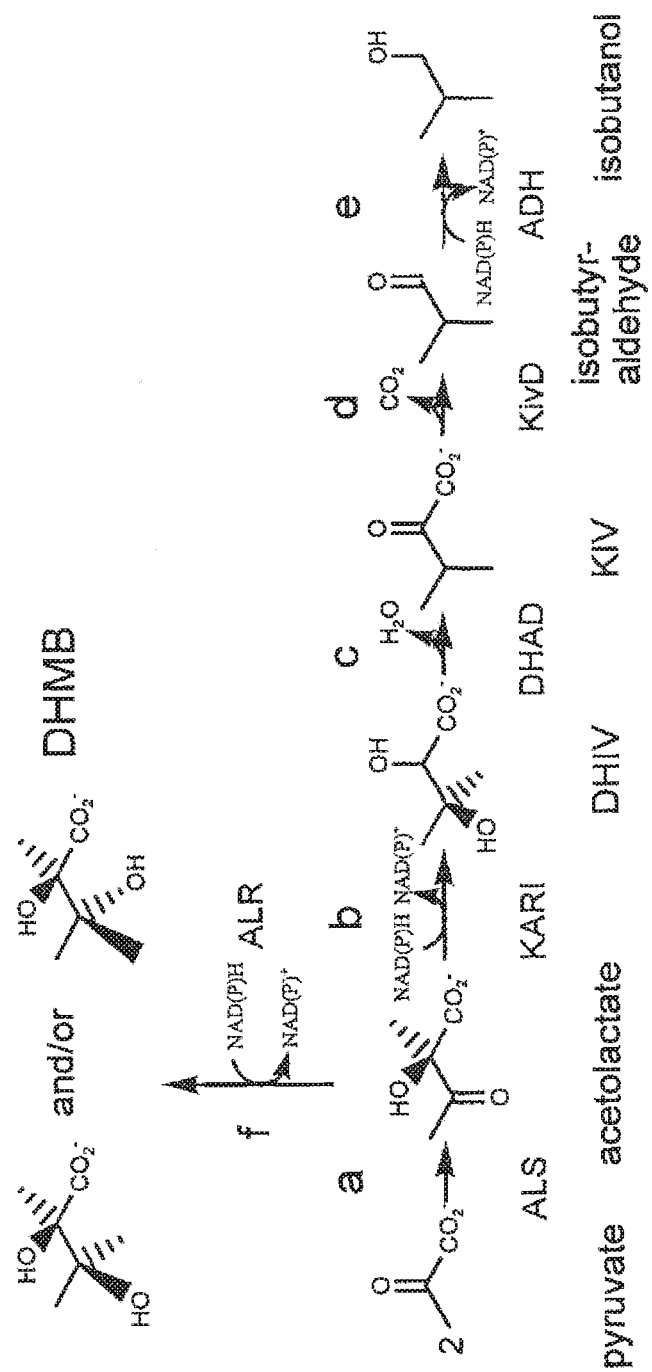

FIG. 10 shows an isobutanol biosynthetic pathway, Step "a" represents the conversion of pyruvate to acetolactate. Step "b" represents the conversion of acetolactate to DHIV, Step "c" represents the conversion of DHIV to KIV. Step "d" represents the conversion of KIV to isobutyraldehyde. Step "e" represents the conversion of isobutyraldehyde to isobutanol. Step "f" represents the conversion of acetolactate to DHMB.

Figure 11:
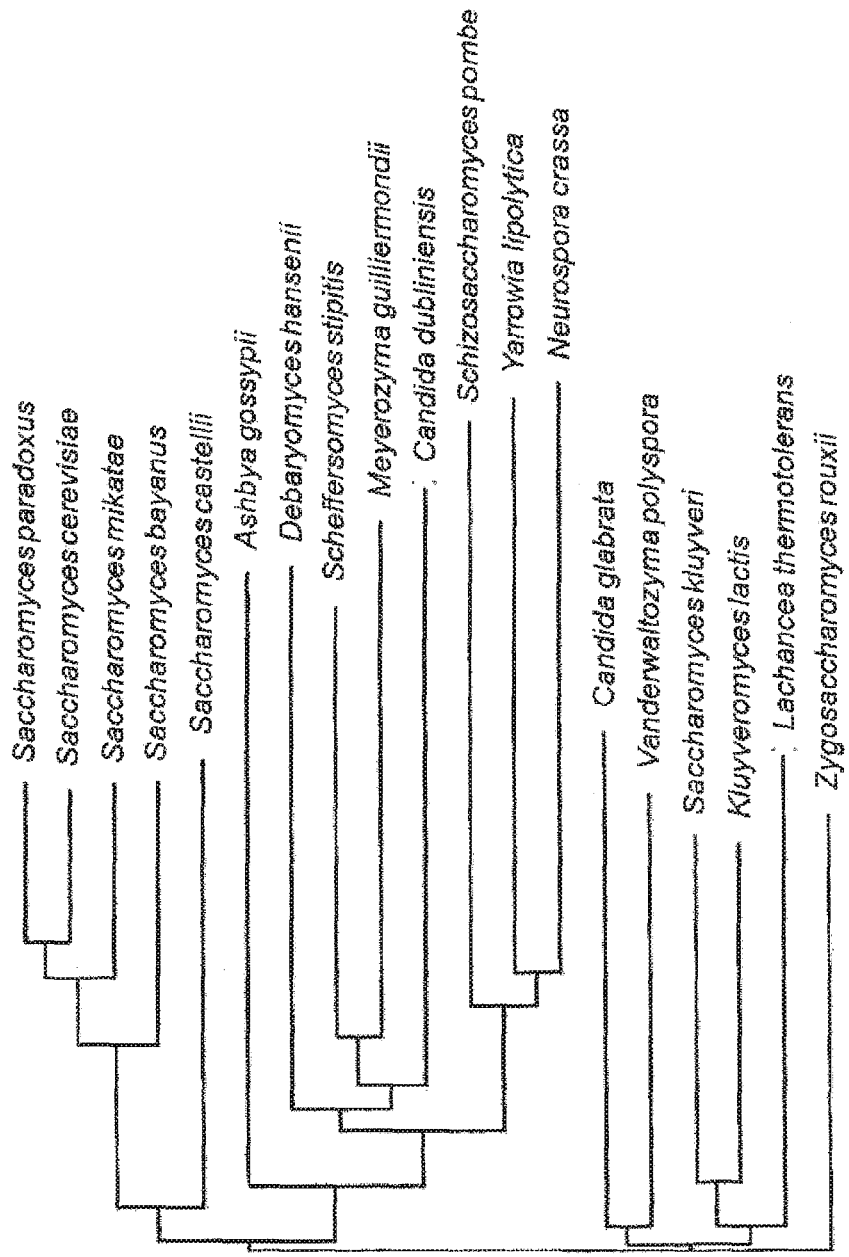

FIG. 11 shows a phylogenetic tree of YMR226C homologs from species of ascomycete yeast. A filamentous fungi (*Neurospora crassa*) sequence is included as an outgroup.

Figure 12A:
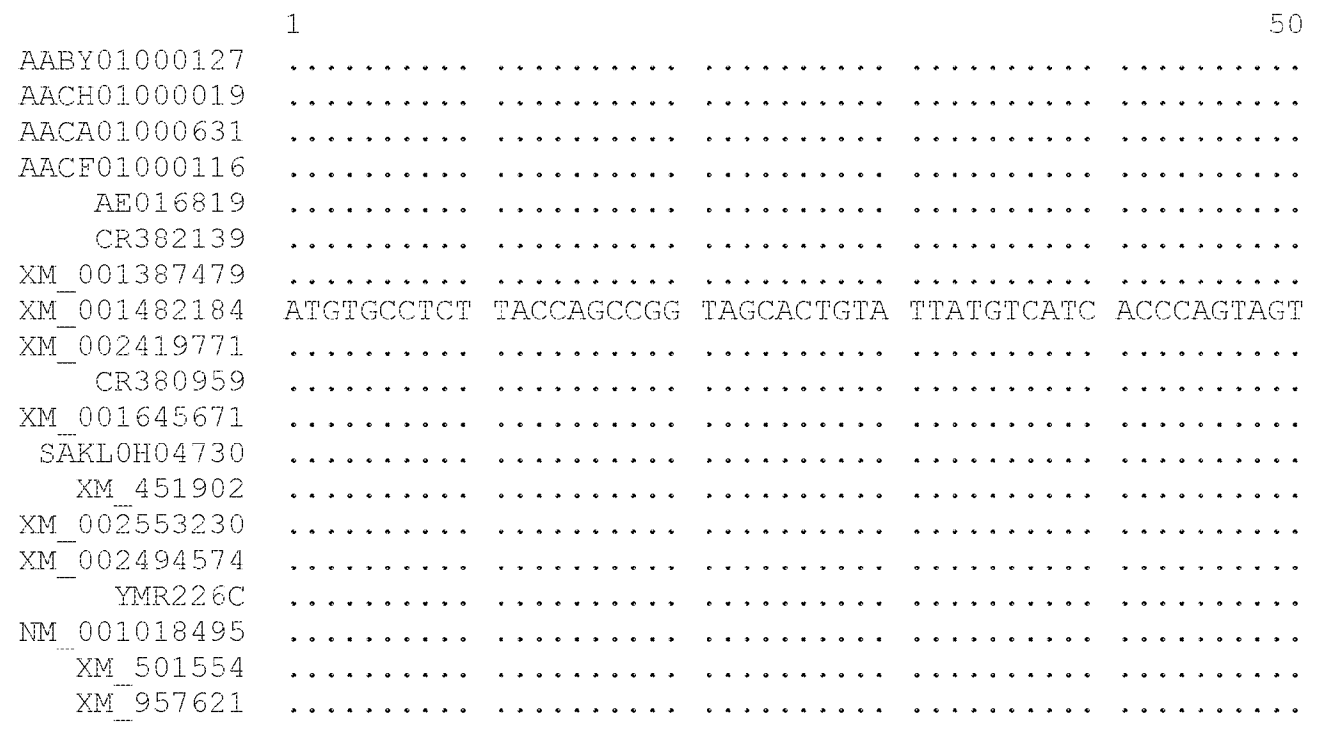

FIGS. 12A-12S show a multiple sequence alignment (MSF Format) of nucleotide sequences of ORFs with homology to YMR226C. The gene names shown correspond to the accession numbers and SEQ ID NOs. given in Table 7. The alignment was produced by AlignX (Vector NTI).

Figure 13:
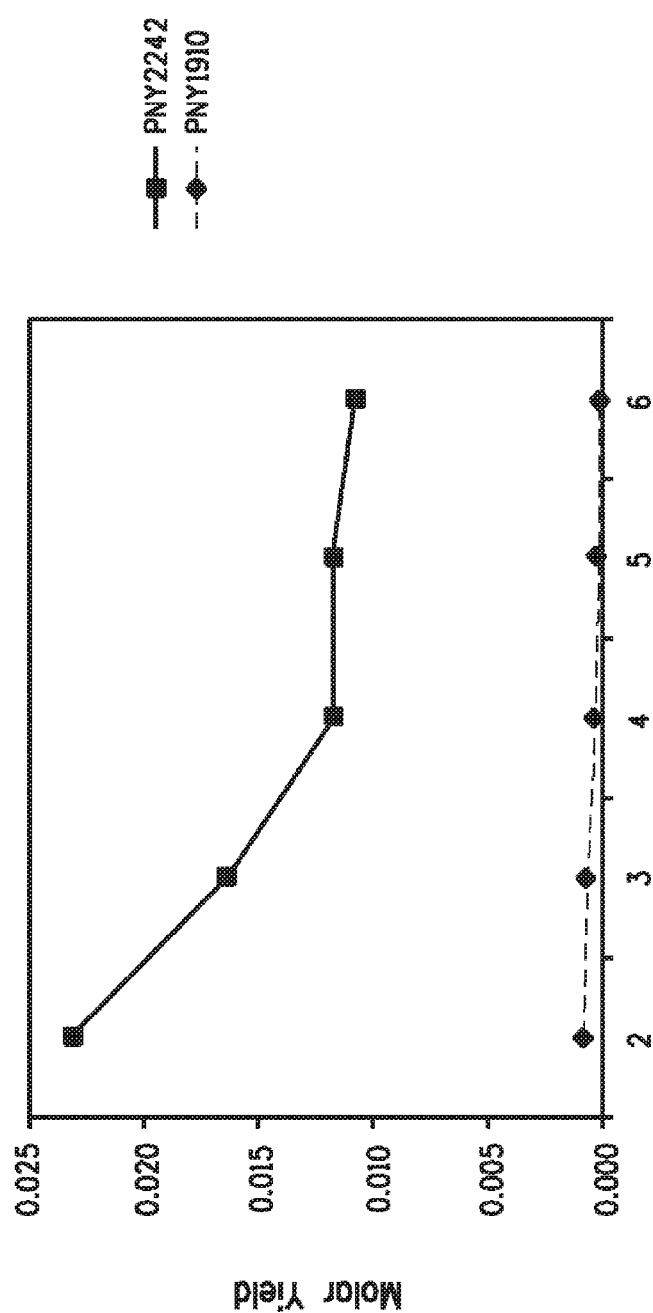

FIG. 13 shows a graph of the molar yield of DHMB over time.

Figure 14:
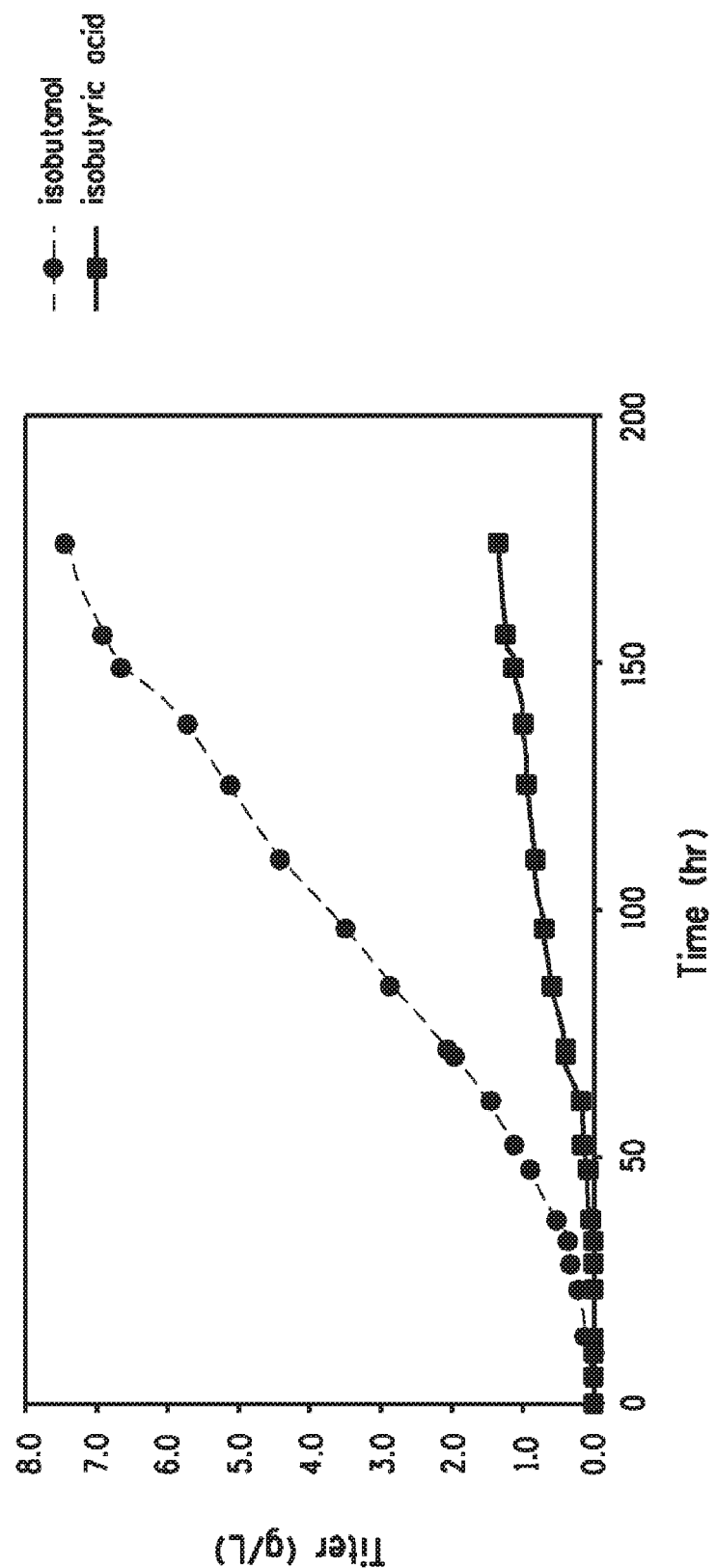

FIG. 14 depicts the production of isobutanol and isobutyric acid in yeast strain NYLA84.

Table Z—is a table (filed electronically herewith and incorporated by reference) of the Profile HMM of experimentally verified KARI enzymes listed in Table 1 and as described in US App. Pub. Nos. 2010/0197519 and 2009/0163376, which are herein incorporated by reference in their entireties.

TABLE 1

Experimentally verified KARI enzymes.

| GI Number | Accession | SEQ ID NO: | Microorganism |
|---|---|---|---|
| 70732562 | YP_262325.1 | 5 | *Pseudomonas fluorescens* Pf-5 |
| 15897495 | NP_342100.1 | 1 | *Sulfolobus solfataricus* P2 |
| 18313972 | NP_560639.1 | 2 | *Pyrobaculum aerophilum* str. IM2 |
| 76801743 | YP_326751.1 | 7 | *Natronomonas pharaonis* DSM 2160 |
| 16079881 | NP_390707.1 | 8 | *Bacillus subtilis* subsp. *subtilis* str. 168 |
| 19552493 | NP_600495.1 | 9 | *Corynebacterium glutamicum* ATCC 13032 |
| 6225553 | O32414 | 10 | *Phaeospirilum molischianum* |
| 17546794 | NP_520196.1 | 3 | *Ralstonia solanacearum* GMI1000 |
| 56552037 | YP_162876.1 | 11 | *Zymomonas mobilis* subsp. *mobilis* ZM4 |
| 114319705 | YP_741388.1 | 12 | *Alkalilimnicola ehrlichei* MLHE-1 |
| 57240359 | ZP_00368308.1 | 13 | *Campylobacter lari* RM2100 |
| 120553816 | YP_958167.1 | 14 | *Marinobacter aquaeolei* VT8 |
| 71065099 | YP_263826.1 | 15 | *Psychrobacter arcticus* 273-4 |
| 83648555 | YP_436990.1 | 16 | *Hahella chejuensis* KCTC 2396 |
| 74318007 | YP_315747.1 | 17 | *Thiobacillus denitrificans* ATCC 25259 |
| 67159493 | ZP_00420011.1 | 18 | *Azotobacter vinelandii* AvOP |
| 66044103 | YP_233944.1 | 19 | *Pseudomonas syrigae* pv. *syrigae* B728a |
| 28868203 | NP_790822.1 | 20 | *Pseudomonas syrigae* pv. *tomato* str. DC3000 |
| 26991362 | NP_746787.1 | 21 | *Pseudomonas putida* KT2440 |
| 104783656 | YP_610154.1 | 22 | *Pseudomonas entomophila* L48 |
| 146306044 | YP_001186509.1 | 23 | *Pseudomonas mendocina* ymp |
| 15599888 | NP_253382.1 | 4 | *Pseudomonas aeruginosa* PAO1 |
| 42780593 | NP_977840.1 | 24 | *Bacillus cereus* ATCC 10987 |
| 42781005 | NP_978252.1 | 25 | *Bacillus cereus* ATCC 10987 |
| 266346 | Q01292 | 6 | *Spinacia oleracea* |

The eleven positions in the profile HMM representing the columns in the alignment which correspond to the eleven cofactor switching positions in *Pseudomonas fluorescens* Pf-5 KARI are identified as positions 24, 33, 47, 50, 52, 53, 61, 80, 115, 156, and 170. Table Z is submitted herewith electronically and is incorporated herein by reference.

The sequences provided in the sequence listing filed herewith (Name: 20120323_CL5367USNA_SEQLIST.txt; Size 2,003,893 bytes; Date of Creation Mar. 23, 2012), is herein incorporated by reference.

Consistent with the World Intellectual Property Organization (WIPO) Standard ST.25 (2009), certain primers given in the sequence listing and herein use N to represent nucleotides a or g or c or t. K is used to represent g or t. M is used to represent a or c.

DETAILED DESCRIPTION OF THE INVENTION

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes as if each individual publication or patent application were specifically and individually indicated to be incorporated by reference, unless only specific sections of patents or patent publications are indicated to be incorporated by reference.

Although methods and materials similar or equivalent to those disclosed herein can be used in practice or testing of the present invention, suitable methods and materials are disclosed below. The materials, methods and examples are illustrative only and are not intended to be limiting. Other features and advantages of the invention will be apparent from the detailed description and from the claims.

Figure 1:
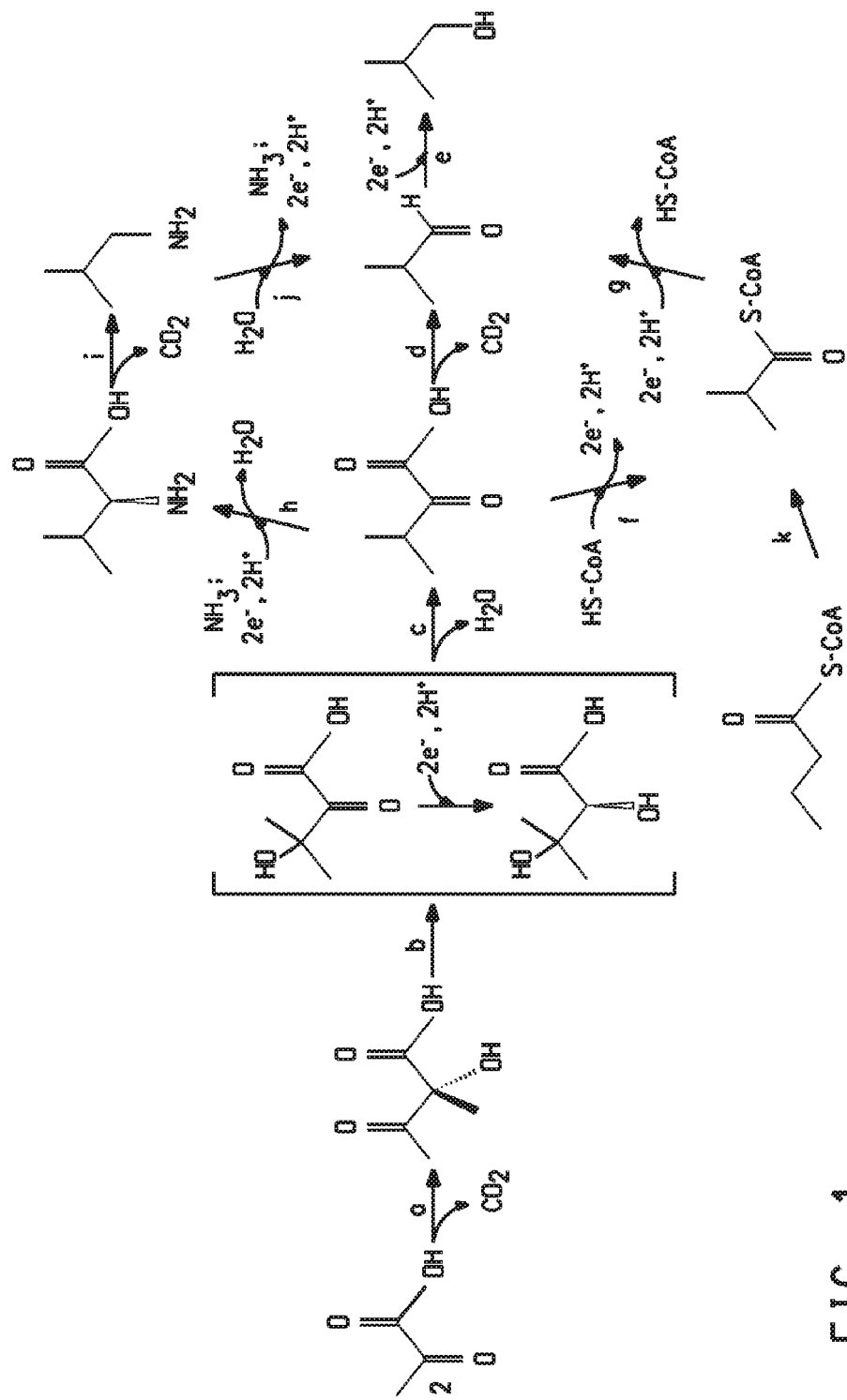

The last step in the biosynthesis of isobutanol via a pyruvate-utilizing biosynthetic pathway is the conversion of isobutyraldehyde to isobutanol (FIG. 1). A side reaction in this pathway is the conversion of isobutyraldehyde to isobutyric acid which results in reduced amounts of isobutyraldehyde available to convert into isobutanol and reduced isobutanol yield. For an efficient biosynthetic process, there is a need to prevent the conversion of isobutyraldehyde to isobutyric acid such that increased amounts of isobutyraldehyde are available for conversion to isobutanol and isobutanol yields are increased.

Aldehyde dehydrogenases are a family of enzymes that catalyze the oxidation (dehydrogenation) of aldehydes (Wang et al., *J. Bacteriol.* 180:822-30, 1998; Navarro-Avino et al., *Yeast* 15:829-42, 1999; and Saint-Prix et al., *Microbiology* 150:2209-20, 2004). There is a need to identify suitable aldehyde dehydrogenases that can be modified to reduce or eliminate aldehyde dehydrogenase activity, and can reduce or eliminate the conversion of isobutyraldehyde to isobutyric acid, such that increased amounts of isobutyraldehyde are available for conversion to isobutanol and isobutanol yields are increased.

Aldehyde oxidases are a family of enzymes that catalyze the production of carboxylic acids from aldehydes (Nomura et al., *Biosci. Biotechnol. Biochem.* 62:1134-7, 1998; and Johnson et al., *Genetics* 151:1379-1391, 1999). There is a need to identify suitable aldehyde oxidases that can be modified to reduce or eliminate aldehyde oxidase activity and can reduce or eliminate the conversion of isobutyraldehyde to isobutyric acid, such that increased amounts of isobutyraldehyde are available for conversion to isobutanol and isobutanol yields are increased.

The biosynthesis pathway for the production of butanol in genetically engineered yeast includes the conversion of acetolactate to 2,3-dihydroxy-3-isovalerate (DHIV), which is subsequently converted to butanol. See FIG. 10. However, a side reaction in this pathway, which decreases the overall production of butanol, is the conversion of acetolactate to 2,3-dihydroxy-2-methylbutyrate (DHMB). In fact, Applicants have discovered that DHMB has inhibitory effects on enzymes (dihydroxyacid dehydratase and ketol-acid reductoisomerase) in an isobutanol production pathway. For an efficient biosynthetic process, there is a need to prevent the conversion of acetolactate to DHMB.

Applicants have solved the stated problems by providing recombinant yeast host cells comprising an isobutanol biosynthetic pathway; and at least one of: i) reduced or eliminated aldehyde dehydrogenase activity ii) reduced or eliminated aldehyde oxidase activity iii) reduced or eliminated acetolactate reductase activity; iv) a heterologous polynucleotide encoding a polypeptide having ketol-acid reductoisomerase activity; and v) a heterologous polypeptide having ketol-acid reductoisomerase activity. Further, Applicants provide methods of producing butanol utilizing such host cells. Such recombinant host cells can be used to increase the production of a product of a biosynthetic pathway (e.g., isobutanol, 1-butanol, or 2-butanol) and/or reduce or eliminate the conversion of pathway intermediates to undesirable byproducts. Applicants have also provided a suitable screening strategy for evaluating various candidate enzymes. The identified enzymes can be altered to enhance the production of a product of a biosynthetic pathway (e.g., isobutanol, 1-butanol, or 2-butanol) and/or reduce or eliminate the conversion of pathway intermediates to undesirable byproducts.

In order to further define this invention, the following terms, abbreviations and definitions are provided.

It will be understood that "derived from" with reference to polypeptides disclosed herein encompasses sequences synthesized based on the amino acid sequences of the KARIs present in the indicated organisms as well as those cloned directly from the organism's genetic material.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements no expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. §2111.03.

Also, the indefinite articles "a" and an preceding an element or component of the invention are intended to be non-restrictive regarding the number of instances, i.e., occurrences of the element or component. Therefore "a" or an should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the claims as presented or as later amended and supplemented, or in the specification.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, or within 5% of the reported numerical value.

As used herein, "synergistic" refers to a greater-than-additive effect produced by a combination (i.e., an effect that is greater than the sum of individual effects) or an additive effect when the individual effects are not expected to be additive. The term also refers to the addition of one compound which results in less of another compound being required.

The term "butanol biosynthetic pathway" as used herein refers to the enzymatic pathway to produce 1-butanol, 2-butanol, or isobutanol. For example, isobutanol biosynthetic pathways are disclosed in U.S. Patent Application Publication No. 2007/0092957, which is incorporated by reference herein.

The term "isobutanol biosynthetic pathway" refers to the enzymatic pathway to produce isobutanol. Certain isobutanol biosynthetic pathways are illustrated in FIG. 1 and described herein. From time to time "isobutanol biosynthetic pathway" is used synonymously with "isobutanol production pathway".

The term "butanol" as used herein refers to 2-butanol, 1-butanol, isobutanol or mixtures thereof. Isobutanol is also known as 2-methyl-1-propanol.

A recombinant host cell comprising an "engineered alcohol production pathway" (such as an engineered butanol or isobutanol production pathway) refers to a host cell containing a modified pathway that produces alcohol in a manner different than that normally present in the host cell. Such differences include production of an alcohol not typically produced by the host cell, or increased or more efficient production.

The term "heterologous biosynthetic pathway" as used herein refers to an enzyme pathway to produce a product in which at least one of the enzymes is not endogenous to the host cell containing the biosynthetic pathway.

The term "extractant" as used herein refers to one or more organic solvents which can be used to extract butanol from a fermentation broth.

The term "effective isobutanol productivity" as used herein refers to the total amount in grams of isobutanol produced per gram of cells.

The term "effective titer" as used herein, refers to the total amount of a particular alcohol (e.g. butanol) produced by fermentation per liter of fermentation medium. The total amount of butanol includes: (i) the amount of butanol in the fermentation medium; (ii) the amount of butanol recovered from the organic extractant; and (iii) the amount of butanol recovered from the gas phase, if gas stripping is used.

The term "effective rate" as used herein, refers to the total amount of butanol produced by fermentation per liter of fermentation medium per hour of fermentation.

The term "effective yield" as used herein, refers to the amount of butanol produced per unit of fermentable carbon substrate consumed by the biocatalyst.

The term "separation" as used herein is synonymous with "recovery" and refers to removing a chemical compound from an initial mixture to obtain the compound in greater purity or at a higher concentration than the purity or concentration of the compound in the initial mixture.

The term "aqueous phase," as used herein, refers to the aqueous phase of a biphasic mixture obtained by contacting a fermentation broth with a water-immiscible organic extractant. In an embodiment of a process described herein that includes fermentative extraction, the term "fermentation broth" then specifically refers to the aqueous phase in biphasic fermentative extraction.

The term "organic phase," as used herein, refers to the non-aqueous phase of a biphasic mixture obtained by contacting a fermentation broth with a water-immiscible organic extractant.

The terms "PDC-," "PDC knockout," or "PDC-KO" as used herein refer to a cell that has a genetic modification to inactivate or reduce expression of a gene encoding pyruvate decarboxylase (PDC) so that the cell substantially or completely lacks pyruvate decarboxylase enzyme activity. If the cell has more than one expressed (active) PDC gene, then each of the active PDC genes can be inactivated or have minimal expression thereby producing a PDC-cell.

The term "polynucleotide" is intended to encompass a singular nucleic acid as well as plural nucleic acids, and refers to a nucleic acid molecule or construct, e.g., messenger RNA (mRNA) or plasmid DNA (pDNA). A polynucleotide can contain the nucleotide sequence of the full-length cDNA sequence, or a fragment thereof, including the untranslated 5' and 3' sequences and the coding sequences. The polynucleotide can be composed of any polyribonucleotide or polydeoxyribonucleotide, which can be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. "Polynucleotide" embraces chemically, enzymatically, or metabolically modified forms.

A polynucleotide sequence can be referred to as "isolated," in which it has been removed from its native environment. For example, a heterologous polynucleotide encoding a polypeptide or polypeptide fragment having dihydroxy-acid dehydratase activity contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA can be comprised of one or more segments of cDNA, genomic DNA or synthetic DNA.

The term "NAD(P)H consumption assay" refers to an enzyme assay for the determination of the specific activity of the KARI enzyme, involving measuring the disappearance of the KARI cofactor, NAD(P)H, from the enzyme reaction. Such assays are described in Aulabaugh and Schloss, Biochemistry 29: 2824-2830, 1990, which is herein incorporated by reference in its entirety.

The term "NAD(P)H" refers to either NADH or NADPH.

"KARI" is the abbreviation for the enzyme ketol-acid reductoisomerase.

The term "close proximity" when referring to the position of various amino acid residues of a KARI enzyme with respect to the adenosyl 2'-phosphate of NADPH means amino acids in the three-dimensional model for the structure of the enzyme that are within about 4.5 Å of the phosphorus atom of the adenosyl 2'-phosphate of NADPH bound to the enzyme.

The term "ketol-acid reductoisomerase" (abbreviated "KARI"), and "acetohydroxy acid isomeroreductase" will be used interchangeably and refer to enzymes capable of catalyzing the reaction of (S)-acetolactate to 2,3-dihydroxyisovalerate, classified as EC number EC 1.1.1.86 (*Enzyme Nomenclature* 1992, Academic Press, San Diego). As used herein the term "Class I ketol-acid reductoisomerase enzyme" means the short form that typically has between 330 and 340 amino acid residues, and is distinct from the long form, called class II, that typically has approximately 490 residues. These enzymes are available from a number of sources, including, but not limited to *E. coli* (amino acid SEQ ID NO: 942; GenBank Accession Number NC_000913 REGION: 3955993.3957468), *Vibrio cholerae* (GenBank Accession Number NC_002505 REGION: 157441.158925), *Pseudomonas aeruginosa*, (GenBank Accession Number NC_002516, REGION: 5272455.5273471), and *Pseudomonas fluorescens* (amino acid SEQ ID NO: 943; GenBank Accession Number NC_004129 REGION: 6017379.6018395). KARI enzymes are described for example, in U.S. Pat. Nos. 7,910,342 and 8,129,162 and U.S. Pub, App, No. 2010/0197519, all of which are herein incorporated by reference in their entireties.

KARI is found in a variety of organisms and amino acid sequence comparisons across species have revealed that there are 2 types of this enzyme: a short form (class I) found in fungi and most bacteria, and a long form (class II) typical of plants. Class I KARIs typically have between 330-340 amino acid residues. The long form KARI enzymes have about 490 amino acid residues. However, some bacteria such as *Escherichia coli* possess a long form, where the amino acid sequence differs appreciably from that found in plants. KARI is encoded by the ilvC gene and is an essential enzyme for growth of *E. coli* and other bacteria in a minimal medium. Class II KARIs generally consist of a 225-residue N-terminal domain and a 287-residue C-terminal domain. The N-terminal domain, which contains the NADPH-binding site, has an αβstructure and resembles domains found in other pyridine nucleotide-dependent oxidoreductases. The C-terminal domain consists almost entirely of α-helices.

Ketol-acid reductoisomerase (KARI) enzymes are useful in pathways for the production of isobutanol using engineered microorganisms (U.S. Pat. Nos. 7,851,188 and 7,993,889, incorporated by reference herein).

A KARI that can utilize NADH can capitalize on the NADH produced by the existing glycolytic and other metabolic pathways in most commonly used microbial cells and can result in improved isobutanol production. Rane et al. (Arch. Biochem. Biophys., 338: 83-89, 1997) discusses cofactor switching of a ketol acid reductoisomerase isolated from *E. coli*. US Appl. Pub. Nos. 2009/0163376 and 2010/0197519 (each of which is herein incorporated by reference it its entirety) describe the generation of KARI enzymes which can use NADH. US Appl. Pub. No. 2010/0143997 (which is herein incorporated by reference in its entirety) describes *E. coli* variants with improved $K_M$ values for NADH.

The terms "ketol-acid reductoisomerase activity" and "KARI activity" refer to the ability to catalyze the substrate to product conversion (S)-acetolactate to 2,3-dihydroxyisovalerate.

The term "acetolactate synthase" refers to an enzyme that catalyzes the conversion of pyruvate to acetolactate and $CO_2$. Acetolactate has two stereoisomers ((R) and (S)); the enzyme prefers the (S)-isomer, which is made by biological systems. Certain acetolactate synthases are known by the EC number 2.2.1.6 (*Enzyme Nomenclature* 1992, Academic Press, San Diego). These enzymes are available from a number of sources, including, but not limited to, *Bacillus subtilis* (GenBank Nos: CAB15618, Z99122, NCBI (National Center for Biotechnology Information) amino acid sequence, NCBI nucleotide sequence, respectively), *Klebsiella pneumoniae* (Gen Bank Nos: AAA25079, M73842 and *Lactococcus lactis* (GenBank Nos: AAA25161, L16975).

The term "acetohydroxy acid dehydratase" refers to an enzyme that catalyzes the conversion of 2,3-dihydroxyisovalerate to α-ketoisovalerate. Certain acetohydroxy acid dehydratases are known by the EC number 4.2.1.9. These enzymes are available from a vast array of microorganisms, including, but not limited to, *E. coli* (GenBank Nos: YP_026248, NC_000913, *S. cerevisiae* (GenBank Nos: NP_012550, NC_001142), *M. maripaludis* (GenBank Nos: CAF29874, BX957219), *B. subtilis* (GenBank Nos: CAB14105, Z99115), *Lactococcus lactis* (SEQ ID NO: 926), and *Streptococcus mutans* (SEQ ID NO: 939).

The term "branched-chain α-keto acid decarboxylase" refers to an enzyme that catalyzes the conversion of α-ketoisovalerate to isobutyraldehyde and $CO_2$. Certain branched-chain α-keto acid decarboxylases are known by the EC number 4.1.1.72 and are available from a number of sources, including, but not limited to, *Lactococcus lactis* (GenBank Nos: AAS49166, AY548760; CAG34226, AJ746364, *Salmonella typhimurium* (GenBank Nos: NP-461346, NC-003197), *Clostridium acetobutylicum* (GenBank Nos: NP-149189, NC-001988), *Macrococcus caseolyticus* (SEQ ID NO: 940), and *Listeria grayi* (SEQ ID NO: 941).

The term "branched-chain alcohol dehydrogenase" refers to an enzyme that catalyzes the conversion of isobutyraldehyde to isobutanol. Certain branched-chain alcohol dehydrogenases are known by the EC number 1.1.1.265, but can also be classified under other alcohol dehydrogenases (specifically, EC 1.1.1.1 or 1.1.1.2). These enzymes utilize NADH (reduced nicotinamide adenine dinucleotide) and/or NADPH as electron donor and are available from a number of sources, including, but not limited to, *S. cerevisiae* (GenBank Nos: NP_010656, NC_001136; NP_014051, NC_001145), *E. coli* (GenBank No: NP_417484), *C. acetobutylicum* (GenBank Nos: NP_349892, NC_003030), *B. indica* (amino acid SEQ ID NO: 945), *A. xylosoxidans* (amino acid SEQ ID NO: 944).

The term "branched-chain keto acid dehydrogenase" refers to an enzyme that catalyzes the conversion of α-ketoisovalerate to isobutyryl-CoA (isobutyryl-cofactor A), using $NAD^+$ (nicotinamide adenine dinucleotide) as electron acceptor. Certain branched-chain keto acid dehydrogenases are known by the EC number 1.2.4.4. These branched-chain keto acid dehydrogenases comprise four subunits, and sequences from all subunits are available from a vast array of microorganisms, including, but not limited to, *B. subtilis* (GenBank Nos: CAB14336, Z99116; CAB14335, Z99116; CAB14334, Z99116; and CAB14337, Z99116) and *Pseudomonas putida* (GenBank Nos: AAA65614, M57613; AAA65615, M57613; AAA65617, M57613; and AAA65618, M57613).

As used herein, "aldehyde dehydrogenase activity" refers to any polypeptide having a biological function of an aldehyde dehydrogenase, including the examples provided herein. Such polypeptides include a polypeptide that catalyzes the oxidation (dehydrogenation) of aldehydes. Such polypeptides include a polypeptide that catalyzes the conversion of isobutyraldehyde to isobutyric acid. Such polypeptides also include a polypeptide that corresponds to Enzyme Commission Numbers EC 1.2.1.3, EC 1.2.1.4 or EC 1.2.1.5. Such polypeptides can be determined by methods well known in the art and disclosed herein.

As used herein, "aldehyde oxidase activity" refers to any polypeptide having a biological function of an aldehyde oxidase, including the examples provided herein. Such polypeptides include a polypeptide that catalyzes carboxylic acids from aldehydes. Such polypeptides include a polypeptide that catalyzes the conversion of isobutyraldehyde to isobutyric acid. Such polypeptides also include a polypeptide that corresponds to Enzyme Commission Number EC 1.2.3.1. Such polypeptides can be determined by methods well known in the art and disclosed herein.

As used herein, "pyruvate decarboxylase activity" refers to the activity of any polypeptide having a biological function of a pyruvate decarboxylase enzyme, including the examples provided herein. Such polypeptides include a polypeptide that catalyzes the conversion of pyruvate to acetaldehyde. Such polypeptides also include a polypeptide that corresponds to Enzyme Commission Number 4.1.1.1. Such polypeptides can be determined by methods well known in the art and disclosed herein. A polypeptide having pyruvate decarboxylate activity can be, by way of example, PDC1, PDC5, PDC6, or any combination thereof.

As used herein, "acetolactate reductase activity" refers to the activity of any polypeptide having the ability to catalyze the conversion of acetolactate to DHMB. Such polypeptides can be determined by methods well known in the art and disclosed herein.

As used herein, "DHMB" refers to 2,3-dihydroxy-2-methyl butyrate. DHMB includes "fast DHMB," which has the 2S, 3S configuration, and "slow DHMB," which has the 2S, 3R configurate. See Kaneko et al., Phytochemistry 39: 115-120 (1995), which is herein incorporated by reference in is entirety and refers to fast DHMB as angliceric acid and slow DHMB as tigliceric acid.

As used herein, "reduced activity" refers to any measurable decrease in a known biological activity of a polypeptide when compared to the same biological activity of the polypeptide prior to the change resulting in the reduced activity. Such a change can include a modification of a polypeptide or a polynucleotide encoding a polypeptide as described herein. A reduced activity of a polypeptide disclosed herein can be determined by methods well known in the art and disclosed herein.

As used herein, "eliminated activity" refers to the complete abolishment of a known biological activity of a polypeptide when compared to the same biological activity of the polypeptide prior to the change resulting in the eliminated activity. Such a change can include a modification of a polypeptide or a polynucleotide encoding a polypeptide as described herein. An eliminated activity includes a biological activity of a polypeptide that is not measurable when compared to the same biological activity of the polypeptide prior to the change resulting in the eliminated activity. An eliminated activity of a polypeptide disclosed herein can be determined by methods well known in the art and disclosed herein.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, or mixtures thereof. Other carbon substrates can include ethanol, lactate, succinate, or glycerol.

"Fermentation broth" as used herein means the mixture of water, sugars (fermentable carbon sources), dissolved solids (if present), microorganisms producing alcohol, product alcohol and all other constituents of the material held in the fermentation vessel in which product alcohol is being made by the reaction of sugars to alcohol, water and carbon dioxide ($CO_2$) by the microorganisms present. From time to time, as used herein the term "fermentation medium" and "fermented mixture" can be used synonymously with "fermentation broth".

"Biomass" as used herein refers to a natural product containing a hydrolysable starch that provides a fermentable sugar, including any cellulosic or lignocellulosic material and materials comprising cellulose, and optionally further comprising hemicellulose, lignin, starch, oligosaccharides, disaccharides, and/or monosaccharides. Biomass can also comprise additional components, such as protein and/or lipids. Biomass can be derived from a single source, or biomass can comprise a mixture derived from more than one source. For example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood, and forestry waste. Examples of biomass include, but are not limited to, corn grain, corn cobs, crop residues such as corn husks, corn stover, grasses, wheat, rye, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

"Feedstock" as used herein means a product containing a fermentable carbon source. Suitable feedstock include, but are not limited to, rye, wheat, corn, sugar cane, and mixtures thereof.

The term "aerobic conditions" as used herein means growth conditions in the presence of oxygen.

The term "microaerobic conditions" as used herein means growth conditions with low levels of oxygen (i.e., below normal atmospheric oxygen levels).

The term "anaerobic conditions" as used herein means growth conditions in the absence of oxygen.

The term "specific activity" as used herein is defined as the units of activity in a given amount of protein. Thus, the specific activity is not directly measured but is calculated by dividing 1) the activity in units/ml of the enzyme sample by 2) the concentration of protein in that sample, so the specific activity is expressed as units/mg, where an enzyme unit is defined as moles of product formed/minute. The specific activity of a sample of pure, fully active enzyme is a characteristic of that enzyme. The specific activity of a sample of a mixture of proteins is a measure of the relative fraction of protein in that sample that is composed of the active enzyme of interest.

The terms "$k_{cat}$" and "$K_M$" are known to those skilled in the art and are described in Enzyme Structure and Mechanism, $2^{nd}$ ed. (Ferst: W.H. Freeman Press, NY, 1985; pp 98-120), $K_M$, the Michaelis constant, is the concentration of substrate that leads to half-maximal velocity. The term "$k_{cat}$", often called the "turnover number", is defined as the maximum number of substrate molecules converted to products per active site per unit time, or the number of times the enzyme turns over per unit time. $k_{cat}=V_{max}/[E]$, where [E] is the enzyme concentration (Ferst, supra). The terms "total turnover" and "total turnover number" are used herein to refer to the amount of product formed by the reaction of a KARI enzyme with substrate.

The term "catalytic efficiency" is defined as the $k_{cat}/K_M$ of an enzyme. Catalytic efficiency is used to quantify the specificity of an enzyme for a substrate.

The term "isolated nucleic acid molecule", "isolated nucleic acid fragment" and "genetic construct" will be used interchangeably and will mean a polymer of RNA or DNA that is single- or double-stranded, optionally containing synthetic, non-natural or altered nucleotide bases. An isolated nucleic acid fragment in the form of a polymer of DNA can be comprised of one or more segments of cDNA, genomic DNA or synthetic DNA.

The term "amino acid" refers to the basic chemical structural unit of a protein or polypeptide. The following abbreviations are used herein to identify specific amino acids:

| Amino Acid | Three-Letter Abbreviation | One-Letter Abbreviation |
| --- | --- | --- |
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene can comprise regulatory sequences and coding sequences that are derived from different sources, or regulatory sequences and coding sequences derived from the same source, but arranged in a manner different than that found in nature. "Endogenous gene" refers to a native gene in its natural location in the genome of a microorganism. A "foreign" gene refers to a gene not normally found in the host microorganism, but that is introduced into the host microorganism by gene transfer. Foreign genes can comprise native genes inserted into a non-native microorganism, or chimeric genes. A "transgene" is a gene that has been introduced into the genome by a transformation procedure.

As used herein, "native" refers to the form of a polynucleotide, gene, or polypeptide as found in nature with its own regulatory sequences, if present.

As used herein the term "coding sequence" or "coding region" refers to a DNA sequence that encodes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, translation leader sequences, introns, polyadenylation recognition sequences, RNA processing sites, effector binding sites and stem-loop structures.

As used herein, "endogenous" refers to the native form of a polynucleotide, gene or polypeptide in its natural location in the organism or in the genome of an organism. "Endogenous polynucleotide" includes a native polynucleotide in its natural location in the genome of an organism. "Endogenous gene" includes a native gene in its natural location in the genome of an organism. "Endogenous polypeptide" includes a native polypeptide in its natural location in the organism transcribed and translated from a native polynucleotide or gene in its natural location in the genome of an organism.

The term "heterologous" when used in reference to a polynucleotide, a gene, or a polypeptide refers to a polynucleotide, gene, or polypeptide not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene can be introduced into the host organism by, e.g., gene transfer. A heterologous gene can include a native coding region with non-native regulatory regions that is reintroduced into the native host. For example, a heterologous gene can include a native coding region that is a portion of a chimeric gene including non-native regulatory regions that is reintroduced into the native host. "Heterologous polypeptide" includes a native polypeptide that is reintroduced into the source organism in a form that is different from the corresponding native polypeptide.

A "transgene" is a gene that has been introduced into the genome by a transformation procedure.

As used herein, the term "modification" refers to a change in a polynucleotide disclosed herein that results in reduced or eliminated activity of a polypeptide encoded by the polynucleotide, as well as a change in a polypeptide disclosed herein that results in reduced or eliminated activity of the polypeptide. Such changes can be made by methods well known in the art, including, but not limited to, deleting, mutating (e.g., spontaneous mutagenesis, random mutagenesis, mutagenesis caused by mutator genes, or transposon mutagenesis), substituting, inserting, down-regulating, altering the cellular location, altering the state of the polynucleotide or polypeptide (e.g., methylation, phosphorylation or ubiquitination), removing a cofactor, introduction of an antisense RNA/DNA, introduction of an interfering RNA/DNA, chemical modification, covalent modification, irradiation with UV or X-rays, homologous recombination, mitotic recombination, promoter replacement methods, and/or combinations thereof. Guidance in determining which nucleotides or amino acid residues can be modified, can be found by comparing the sequence of the particular polynucleotide or polypeptide with that of homologous polynucleotides or polypeptides, e.g., yeast or bacterial, and maximizing the number of modifications made in regions of high homology (conserved regions) or consensus sequences.

The term "recombinant genetic expression element" refers to a nucleic acid fragment that expresses one or more specific proteins, including regulatory sequences preceding (5' non-coding sequences) and following (3' termination sequences) coding sequences for the proteins. A chimeric gene is a recombinant genetic expression element. The coding regions of an operon can form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, enhancers, operators, repressors, transcription termination signals, translation leader sequences, introns, polyadenylation recognition sequences, RNA processing site, effector binding site and stem-loop structure.

The term "promoter" refers to a nucleic acid sequence capable of controlling the expression of a coding sequence or functional RNA. In general, a coding sequence is located 3' to a promoter sequence. Promoters can be derived in their entirety from a native gene, or be composed of different elements derived from different promoters found in nature, or even comprise synthetic nucleic acid segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters". "Inducible promoters," on the other hand, cause a gene to be expressed when the promoter is induced or turned on by a promoter-specific signal or molecule. It is further recognized that since in most cases the exact boundaries of regulatory sequences have not been completely defined, DNA fragments of different lengths can have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths can have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression can also refer to translation of mRNA into a polypeptide.

The term "overexpression," as used herein, refers to expression that is higher than endogenous expression of the same or related gene. A heterologous gene is overexpressed if its expression is higher than that of a comparable endogenous gene. The term overexpression refers to an increase in the level of nucleic acid or protein in a host cell. Thus, overexpression can result from increasing the level of transcription or translation of an endogenous sequence in a host cell or can result from the introduction of a heterologous sequence into a host cell. Overexpression can also result from increasing the stability of a nucleic acid or protein sequence.

As used herein the term "transformation" refers to the transfer of a nucleic acid fragment into the genome of a host microorganism, resulting in genetically stable inheritance. Host microorganisms containing the transformed nucleic acid fragments are referred to as "transgenic" or "recombinant" or "transformed" microorganisms.

The terms "plasmid", "vector" and "cassette" refer to an extra chromosomal element often carrying genes which are not part of the central metabolism of the cell, and usually in the form of circular double-stranded DNA fragments. Such elements can be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The term "site-saturation library" refers to a library which contains random substitutions at a specific amino acid position with up to and including all 20 possible amino acids at once.

The term "error-prone PCR" refers to adding random copying errors by imposing imperfect or 'sloppy' PCR reaction conditions which generate randomized libraries of mutations in a specific nucleotide sequence.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 2A. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 2A

The Standard Genetic Code

| | T | C | A | G |
|---|---|---|---|---|
| T | TTT Phe (F) | TCT Ser (S) | TAT Tyr (Y) | TGT Cys (C) |
| | TTC Phe (F) | TCC Ser (S) | TAC Tyr (Y) | TGC |
| | TTA Leu (L) | TCA Ser (S) | TAA Stop | TGA Stop |
| | TTG Leu (L) | TCG Ser (S) | TAG Stop | TGG Trp (W) |
| C | CTT Leu (L) | CCT Pro (P) | CAT His (H) | CGT Arg (R) |
| | CTC Leu (L) | CCC Pro (P) | CAC His (H) | CGC Arg (R) |
| | CTA Leu (L) | CCA Pro (P) | CAA Gln (Q) | CGA Arg (R) |
| | CTG Leu (L) | CCG Pro (P) | CAG Gln (Q) | CGG Arg (R) |
| A | ATT Ile (I) | ACT Thr (T) | AAT Asn (N) | AGT Ser (S) |
| | ATC Ile (I) | ACC Thr (T) | AAC Asn (N) | AGC Ser (S) |
| | ATA Ile (I) | ACA Thr (T) | AAA Lys (K) | AGA Arg (R) |
| | ATG Met (M) | ACG Thr (T) | AAG Lys (K) | AGG Arg (R) |
| G | GTT Val (V) | GCT Ala (A) | GAT Asp (D) | GGT Gly (G) |
| | GTC Val (V) | GCC Ala (A) | GAC Asp (D) | GGC Gly (G) |
| | GTA Val (V) | GCA Ala (A) | GAA Glu (E) | GGA Gly (G) |
| | GTG Val (V) | GCG Ala (A) | GAG Glu (E) | GGG Gly (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database" available at www.kazusa.or.jp/codon/ (visited Mar. 20, 2008), and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table 2B. This table uses mRNA nomenclature, and so instead of thymine (T) which is found in DNA, the tables use uracil (U) which is found in RNA. Table 2B has been adapted so that frequencies are calculated for each amino acid, rather than for all 64 codons.

TABLE 2B

Codon Usage Table for *Saccharomyces cerevisiae*

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |

TABLE 2B-continued

Codon Usage Table for *Saccharomyces cerevisiae*

| Amino Acid | Codon | Number | Frequency per thousand |
|---|---|---|---|
| Pro | CCU | 38263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |

TABLE 2B-continued

Codon Usage Table for *Saccharomyces cerevisiae*

| Amino Acid | Codon | Number | Frequency per thousand |
|---|---|---|---|
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the Vector NTI Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function (Entelechon GmbH, Regensburg, Germany) and the "backtranseq" function (NRC Saskatoon Bioinformatics, Saskatoon, Saskatchewan, Canada). Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (University of Maryland, Baltimore, Md.). (userpages.umbc.edu/~wug1/codon/sgd/, visited Mar. 19, 2012).

A polynucleotide or nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. Molecular Cloning: A Laboratory Manual, 2nd ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post hybridization washes determine stringency conditions. One set of conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. Another set of stringent conditions uses higher temperatures in which the washes are identical to those above except for the temperature of the final two 30 min washes in 0.2× SSC, 0.5% SDS was increased to 60° C. Another set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50 9.51). For hybridizations with shorter nucleic acids, i.e., oligonucleotides, the position of mismatches becomes more important, and the length of the oligonucleotide determines its specificity (see Sambrook et al., supra, 11.7 11.8). In one embodiment the length for a hybridizable nucleic acid is at least about 10 nucleotides. In one embodiment, a minimum length for a hybridizable nucleic acid is at least about 15 nucleotides; at least about 20 nucleotides; or the length is at least about 30 nucleotides. Furthermore, the skilled artisan will recognize that the temperature and wash solution salt concentration can be adjusted as necessary according to factors such as length of the probe.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino adds, are included within the definition of "polypeptide," and the term "polypeptide" can be used instead of, or interchangeably with any of these terms. A polypeptide can be derived from a natural biological source or produced by recombinant technology, but is not necessarily translated from a designated nucleic acid sequence. It can be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, the terms "variant" and "mutant" are synonymous and refer to a polypeptide differing from a specifically recited polypeptide by one or more amino acid insertions, deletions, mutations, and substitutions, created using, e.g., recombinant DNA techniques, such as mutagenesis. Guidance in determining which amino acid residues can be replaced, added, or deleted without abolishing activities of interest, can be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences.

"Engineered polypeptide" as used herein refers to a polypeptide that is synthetic, i.e., differing in some manner from a polypeptide found in nature.

Alternatively, recombinant polynucleotide variants encoding these same or similar polypeptides can be synthesized or selected by making use of the "redundancy" in the genetic code. Various codon substitutions, such as silent changes which produce various restriction sites, can be introduced to optimize cloning into a plasmid or viral vector for expression. Mutations in the polynucleotide sequence can be reflected in the polypeptide or domains of other peptides added to the polypeptide to modify the properties of any part of the polypeptide. For example, mutations can be used to reduce or eliminate expression of a target protein and include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed.

Amino acid "substitutions" can be the result of replacing one amino acid with another amino acid having similar structural and/or chemical properties, i.e., conservative amino acid replacements, or they can be the result of replacing one amino acid with an amino acid having different structural and/or chemical properties, i.e., non-conservative amino acid replacements. "Conservative" amino acid substitutions can be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino adds include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" can be within the range of variation as structurally or functionally tolerated by the recombinant proteins. The variation allowed can be experimentally determined by systematically making insertions, deletions, or substitutions of amino acids in a polypeptide molecule using recombinant DNA techniques and assaying the resulting recombinant variants for activity.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides can be used in sequence-dependent methods of gene identification (e.g., Southern hybridization) and isolation (e.g., in situ hybridization of bacterial colonies or bacteriophage plaques). In addition, short oligonucleotides of 12-15 bases can be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, can now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenine is complementary to thymine and cytosine is complementary to guanine, and with respect to RNA, adenine is complementary to uracil and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Methods to determine identity are designed to give the best match between the sequences tested. Methods to determine identity and similarity are codified in publicly available computer programs. Sequence alignments and percent identity calculations can be performed using the MegAlign™ program of the LASERGENE bioinformatics computing suite (DNASTAR Inc., Madison, Wis.). Multiple alignments of the sequences are performed using the "Clustal method of alignment" which encompasses several varieties of the algorithm including the "Clustal V method of alignment" corresponding to the alignment method labeled Clustal V (described by Higgins and Sharp, *CABIOS*. 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, such as from other species, wherein such polypeptides have the same or similar function or activity, or in describing the corresponding polynucleotides. Useful examples of percent identities include, but are not limited to: 55%, 60%, 65%, 70%, 75%, 80%, 85%, 90%, or 95%, or any integer percentage from 55% to 100% can be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable polynucleotide fragments not only have the above homologies but typically comprise a polynucleotide having at least 50 nucleotides, at least 100 nucleotides, at least 150 nucleotides, at least 200 nucleotides, or at least 250 nucleotides. Further, suitable polynucleotide fragments having the above homologies encode a polypeptide having at least 50 amino acids, at least 100 amino acids, at least 150 amino acids, at least 200 amino acids, or at least 250 amino acids.

The term "sequence analysis software" refers to any computer algorithm or software program that is useful for the analysis of nucleotide or amino acid sequences. "Sequence analysis software" can be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Other molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 Jan. 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology, Volume 201, Issue 2, Pages 405-421; Albert, et al. (1995) The Plant Journal. Volume 7, Issue 4, pages 649-659), "seamless" gene deletion (Akada, et al, (2006) Yeast; 23(5): 399-405), and gap repair methodology (Ma et al., *Genetics* 58:201-216; 1981).

The genetic manipulations of a recombinant host cell disclosed herein can be performed using standard genetic techniques and screening and can be made in any host cell that is suitable to genetic manipulation (*Methods in Yeast Genetics,* 2005, Cold Spring Harbor Laboratory Press, Cold Spring Harbor, N.Y., pp. 201-202).

In embodiments, a recombinant host cell disclosed herein can be any yeast or fungi host useful for genetic modification and recombinant gene expression including those yeast mentioned elsewhere herein, such as in Table 7. In other embodiments, a recombinant host cell can be a member of the genera *Issatchenkia, Zygosaccharomyces, Schizosaccharomyces, Dekkera, Torulopsis, Brettanomyces, Torulaspora, Hanseniaspora, Kluveromyces, Yarrowia*, and some species of *Candida*.

Polypeptides with KARI Activity

In some embodiments, the recombinant host cells and methods provided herein address a need that arises in the microbial production of isobutanol where the KARI enzyme performs a vital role. In the isobutanol biosynthetic pathway shown in FIG. 1, the substrate to product conversion of acetolactate to dihydroxyisovalerate (DHIV) is catalyzed by the KARI enzyme. Disclosed in US Appl. Publication No. US2011/0244536 and incorporated by reference, are polypeptides having ketol-acid reductoisomerase activity that are members of the SLSL Clade of KARIs. Polypeptides having KARI activity disclosed therein were found to be effective for isobutanol production. The SLSL Clade of KARIs include those KARI enzymes listed in Table 3.

TABLE 3

Effective KARIs

| Description | SEQ ID NO: Nucleic acid | SEQ ID NO: Amino acid |
|---|---|---|
| *Staphylococcus capitis* SK14 | 66 | 67 |
| *Staphylococcus epidermidis* M23864-W1 | 68 | 69 |
| *Staphylococcus hominis* SK119 | 134 | 135 |
| *Staphylococcus aureus* subsp. *aureus* TCH130 | 70 | 71 |
| *Staphylococcus warneri* L37603 | 72 | 73 |
| *Staphylococcus epidermidis* W23144 | 74 | 75 |

TABLE 3-continued

Effective KARIs

| Description | SEQ ID NO: Nucleic acid | SEQ ID NO: Amino acid |
|---|---|---|
| *Staphylococcus saprophyticus* subsp. *Saprophyticus* ATCC15305 | 76 | 77 |
| *Staphylococcus carnosus* subsp. *Carnosus* TM300 | 78 | 79 |
| *Listeria monocytogenes* EGD-e | 80 | 81 |
| *Listeria grayi* DSM 20601 | 82 | 83 |
| *Enterococcus casseliflavus* EC30 | 84 | 85 |
| *Enterococcus gallinarum* EG2 | 86 | 87 |
| *Macrococcus caseolyticus* JCSC5402 | 88 | 89 |
| *Streptococcus vestibularis* | 90 | 91 |
| *Streptococcus mutans* UA159 | 92 | 93 |
| *Streptococcus gordonii* str, *cgakkus* sybstr. CH1 | 94 | 95 |
| *Streptococcus suis* 89/1591 | 96 | 97 |
| *Streptococcus infantarius* subsp. *infantarius* ATCC BAA-102 | 98 | 99 |
| *Lactococcus lactis* subsp *cremoris* MG1363 | 100 | 101 |
| *Lactococcus lactis* | 102 | 103 |
| *Leuconostoc mesenteroides* subsp *mesenteroides* ATCC8293 | 104 | 105 |
| *Lactobacillus buchneri* ATCC 11577 | 106 | 107 |
| *Staphylococcus haemolyticus* JCSC1435 | 108 | 109 |
| *Staphylococcus epidermidis* ATCC12228 | 110 | 111 |
| *Streptococcus pneumoniae* CGSP14 | 112 | 113 |
| *Streptococcus pneumoniae* TIGR4 | 114 | 115 |
| *Streptococcus sanguinis* SK36 | 116 | 117 |
| *Streptococcus salivarius* SK126 | 118 | 119 |
| *Streptococcus thermophilus* LMD-9 | 120 | 121 |
| *Streptococcus pneumoniae* CCRI 1974M2 | 122 | 123 |
| *Lactococcus lactis* subsp. *lactis* Il1403 | 124 | 125 |
| *Leuconostoc mesenteroides* subsp *cremoris* ATCC19254 | 126 | 127 |
| *Leuconostoc mesenteroides* subsp *cremoris* | 128 | 129 |
| *Lactobacillus brevis* subsp. *gravesensis* ATCC27305 | 130 | 131 |
| *Lactococcus lactis* subsp *lactis* NCDO2118 | 132 | 133 |

As described and demonstrated herein, Applicants have discovered additional KARI enzymes and variants of the additional KARIs that result in isobutanol production comparable to and/or exceeding that observed with the KARI from *Lactococcus lactis*. Such KARI enzymes and variants result in comparable or higher isobutanol titer and/or higher effective isobutanol productivity when compared to that observed with *Lactococcus lactis* KARI in the same conditions. Accordingly, in embodiments, polypeptides having KARI activity that function in an isobutanol production pathway have isobutanol titer and/or effective isobutanol productivity comparable to or better than that with the *Lactococcus lactis* KARI (SEQ ID NO: 380).

Such polypeptides having KARI activity may thus be suitable for isobutanol production. It will be appreciated that using a combination of structural and sequence information available in the art, polypeptides comprising KARI activity and less than 100% identity to the exemplified sequences can be constructed for use in isobutanol biosynthetic pathways. For example, crystal structures of the *E. coli* KARI enzyme at 2.6 Å resolution have been solved (Tyagi, et al., Protein Sci., 14: 3089-3100, 2005) as has the structure of the *P. aeruginosa* KARI (Ahn, et al., J. Mol. Biol., 328: 505-515, 2003) and the KARI enzyme from spinach (Biou V., et al. The EMBO Journal, 16: 3405-3415, 1997). Furthermore, described herein is a Profile HMM (provided herein; Table Z) prepared using amino acid sequences of 25 KARI proteins with experimentally verified function as outlined in Table 1. The KARIs were from *Pseudomonas fluorescens* Pf-5, *Sulfolobus solfataricus* P2, *Pyrobaculum aerophilum* str. IM2, *Natronomonas pharaonis* DSM 2160, *Bacillus subtilis* subsp. *subtilis* str. 168, *Corynebacterium glutamicum* ATCC 13032, *Phaeospririlum molischianum*, *Raistonia solanacearum* GM 000, *Zymomonas mobilis* subsp. *mobilis* ZM4, *Alkalilimnicola ehrlichei* MLHE-, *Campylobacter lari* RM2100, *Marinobacter aquaeolei* VT8, *Psychrobacter arcticus* 273-4, *Hahella chejuensis* KCTC 2396, *Thiobacillus denitrificans* ATCC 25259, *Azotobacter vinelandii* AvOP, *Pseudomonas syringae* pv. *syringae* B728a, *Pseudomonas syringae* pv. *tomato* str. DC3000, *Pseudomonas putida* KT2440, *Pseudomonas entomophila* L48, *Pseudomonas mendocina* ymp, *Pseudomonas aeruginosa* PAO1, *Bacillus cereus* ATCC 10987, *Bacillus cereus* ATCC 10987, and *Spinacia oleracea*. Any protein that matches the Profile HMM with an E value of $<10^{-3}$ using hmmsearch program in the HMMER package is expected to be a functional KARI.

Production of isobutanol is believed to utilize the glycolysis pathway present in the host microorganism. During the production of two molecules of pyruvate from glucose during glycolysis, there is net production of two molecules of NADH from NAD+ by the glyceraldehyde-3-phosphate dehydrogenase reaction. During the further production of one molecule of isobutanol from two molecules of pyruvate, there is net consumption of one molecule of NAD(P)H, by the KARI reaction, and one molecule of NAD(P)H by the isobutanol dehydrogenase reaction. The interconversion of NADH with NADPH is generally slow and inefficient in yeast; thus, NADPH to be consumed is generated by metabolism (for example, by the pentose phosphate pathway) consuming substrate in the process. Meanwhile, the cell strives to maintain homeostasis in the NAD+/NADH ratio, leading to the excess NADH produced in isobutanol production being consumed in wasteful reduction of other metabolic intermediates; e.g., by the production of glycerol (Bakker, et al., 2001. Stoichiometry and compartmentation of NADH metabolism in *Saccharomyces cerevisiae*. FEMS Microbiol. Rev. 25:15-37). Thus, an imbalance between NADH produced and NADPH consumed by the isobutanol pathway can lead to a reduction in the molar yield of isobutanol produced from glucose in two ways: 1) unnecessary operation of metabolism to produce NADPH, and 2) wasteful reaction of metabolic intermediates to maintain NAD+/NADH homeostasis. Polypeptides having KARI activity that function well in an isobutanol pathway and have a low $K_M$ for NADH can be used to improve the production of isobutanol.

Also disclosed herein are substitutions to the KARI enzyme sequences provided in Table 3 and in Table 10 to produce variants with varying ability to utilize NADH as a cofactor. Such variants provide alternatives that may be employed to optimize the efficiency of a biosynthetic pathway utilizing KARI, such as an isobutanol biosynthetic pathway, for particular production conditions. Demonstrated in the Examples is isobutanol production under conditions switched from aerobic to anaerobic for variants of the K9 KARI enzyme derived from *Anaerostipes caccae* with differing abilities to utilize NADH. Thus, equipped with this disclosure, one of skill in the art will be able to produce recombinant host cells comprising a SLSL Glade KARI enzyme, or a an *Enterococcus gallinarum*, *Streptococcus thermophilus* *Lactococcus lactis* subsp. *cremoris* MG1363, *Bifidobacterium angulatum*, *Bifidobacterium dentium*, or *Anaerostipes caccae*, *Lactococcus lactis* KARI enzyme or a variant or active fragment thereof suited for a range of production conditions.

In some embodiments, provided herein is a polypeptide having KARI activity and having at least about 80%, at least about 85%, at least about 90%, at least about 95%, at least about 98%, or at least about 99% identity to a KARI enzyme of Table 3 or Table 10, or Examples 16, 17, 21 and having a $K_M$ for NADH less than about 300 μM, 100 μM, 50 μM, 20 μM, 10 μM, or 5 μM. In some embodiments, provided herein is an engineered polypeptide having KARI activity and having at least about 80%, at least about 85%, at least about 90%, at least about 95%, at least about 98%, or at least about 99% identity to a KARI enzyme of Table 3, Table 10 or Examples 16, 17, 21. In some embodiments, such polypeptides have a $K_M$ for NADH less than that of the corresponding native enzyme. In some embodiments, the ratio of $K_M$ for NADH to $K_M$ for NAPDH is less than 0.1, in some embodiments less than 1, in some embodiments less than 2, in some embodiments, less than 4.

KARI enzymes and variants thereof that are particularly suitable for isobutanol production include, but are not limited to, variants of a ketol-acid reductoisomerase from *Anaerostipes caccae* DSM 14662 (SEQ ID NO: 643): "K9G9" (SEQ ID NO: 644) and "K9D3" (SEQ ID NO: 645) which have $K_M$ for NADH lower than that of the native enzyme (SEQ ID NO: 643).

Host cells provided herein may comprise a polypeptide having ketol-acid reductoisomerase activity. In embodiments, such polypeptides have at least about 80%, at least about 85%, at least about 90%, at least about 95%, at least about 98%, or at least about 99% identity to SEQ ID NO: 643, an active variant thereof; or a KARI derived from *Anaerostipes caccae* DSM 14662, or an active variant thereof. In embodiments, the polypeptides have at least about 80%, at least about 85%, at least about 90%, at least about 95%, at least about 98%, or at least about 99% identity to SEQ ID NO: 645 or 644. In embodiments, the polypeptides comprise SEQ ID NO: 645 or 644.

In some embodiments, polypeptides having KARI activity comprise at least about 80%, at least about 85%, at least about 90%, at least about 95%, at least about 98%, or at least about 99% identity to the amino acid sequence of SEQ ID NO: 419 [JB4P], 427 [SB2], and all those variants listed in Tables 25 and 26. Such variants provide alternatives for optimizing the efficiency of the isobutanol biosynthetic pathway for particular production conditions. Demonstrated in the Examples is isobutanol production under conditions.

Identification of Additional Polypeptides Having KARI Activity

Described in Example 1 is a biodiversity screen of KARI-encoding genes from various bacterial and fungal species which revealed suitable KARIs for isobutanol production. Equipped with this disclosure, one of skill in the art will be readily able to identify additional suitable polypeptides having KARI activity.

The sequences of other polynucleotides, genes and/or polypeptides can be identified in the literature and in bioinformatics databases well known to the skilled person using sequences disclosed herein and available in the art. For example, such sequences can be identified through BLAST searching of publicly available databases with polynucleotide or polypeptide sequences provided herein. In such a method, identities can be based on the Clustal W method of alignment using the default parameters of GAP PENALTY=10, GAP LENGTH PENALTY=0.1, and Gonnet 250 series of protein weight matrix.

Additionally, polynucleotide or polypeptide sequences disclosed herein can be used to identify other KARI homologs in nature. For example, each of the KARI encoding nucleic acid fragments disclosed herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor et al., Proc. Acad. Sci. USA 82:1074 (1985); or strand displacement amplification (SDA), Walker et al., Proc. Natl. Acad. Sci. U.S.A., 89:392 (1992)]; and (3) methods of library construction and screening by complementation.

It will be appreciated that one of ordinary skill in the art, equipped with this disclosure, can generate active fragments of polypeptides provided herein, for example, by truncating polypeptides provided herein based on sequence alignments at the N-terminus and confirming KARI activity. In embodiments, *Anaerostipes caccae* KARIs and variants thereof provided herein are truncated at the N-terminus. In one embodiment, up to and including the first five amino acids are truncated from a polypeptide provided herein. In embodiments, the polypeptide is SEQ ID NO: 27 or a variant thereof. In one embodiment, a polypeptide having KARI activity comprises SEQ ID NO: 635, 637 (encoded by polynucleotide sequences SEQ ID NO: 636 and 638, respectively), K9_Annabel_SH (SEQ ID NO:862, protein SEQ ID NO:863) and K9_Zeke_SH (SEQ ID NO: 860, protein SEQ ID NO: 861), or any variant listed in Table 40.

Lowering $K_M$ for NADH

As shown in FIG. 2 and Examples, mutations in the positions corresponding to 50, 52 and 53, and optionally 47, of the *Pseudomonas fluorescens* KARI in the KARI enzyme from *Anaerostipes caccae* result in KARIs with lowered $K_M$ for NADH as compared to wild-type, verifying that mutations in these positions produce NADH accepting variants of highly effective KARIs. Further mutations of *Anaerostipes caccae* KARI, revealed positions which further lower the $K_M$ for NADH.

As demonstrated herein (see Examples), substitution of amino acids in the phosphate binding region, particularly in two or more positions corresponding to positions 47, 50, 52, and 53 of PF5 KARI (SEQ ID NO: 5) results in lowered $K_M$ for NADH. Therefore, provided herein are polypeptides derived from an organism listed herein, for example, in Tables 3 and 10 having KARI activity and comprising substitutions at least two of the four positions corresponding to positions 47, 50, 52, and 53 of PF5 KARI as compared to the native amino acid sequence. Provided herein are polypeptides having KARI activity and comprising substitutions in the phosphate binding region. Provided herein are polypeptides having KARI activity and comprising substitutions at positions corresponding to S56 and S58 of K9 KARI (SEQ ID NO: 27). In some embodiments the substitution at the position corresponding to S56 is A. In some embodiments, the substitution at the position corresponding to S58 is D or E. In some embodiments, the substitution at the position corresponding to S53 is Q, E, P, or A. In some embodiments, the substitution at the position corresponding to S56 is V or D. In some embodiments, the substitution at the position corresponding to S58 is D or Q. In embodiments, the polypeptides further comprise a substitution at one or more positions corresponding to I86, N87, N107, T131, or T191 of K9 KARI (SEQ ID NO: 27). In some embodiments, the polypeptides comprise a substitution at least 2, at least 3, at least 4, or all of the indicated positions. In some embodiments, the substitution at the position corresponding to I86 is T or V. In some embodiments, the substitution at the position corresponding to N87 is P. In some embodiments, the substitution at the position corresponding to N107 is S. In some embodiments, the substitution at the position corresponding to T131 is C, L, A, M or V. In some embodiments, the substitution at the position corresponding to T191 is A, S, D, C, or G.

In embodiments, the polypeptides comprise fewer than 10, 15, or substitutions with respect to the wild-type sequence. In embodiments, the polypeptides match the Profile HMM based on experimentally verified KARIs and given in Table Z with an E value less than <10$^{-3}$. Sequences can be compared to the profile HMM given in Table Z using hmmsearch (HMMER software package available from Janelia Farm Research Campus, Ashburn, Va.).

Additional polypeptides having KARI activity and lowered $K_M$ for NADH can be obtained using methods described and demonstrated herein. For example, a polypeptide having KARI activity can be employed in the construction of a site-saturation gene library as described herein. Kits for construction of such gene libraries are commercially available (for example, from USB Corporation, Cleveland, Ohio, #78480.) Site-directed mutagenesis can also be carried out using commercially available kits (for example, the QuickChange II XL site directed mutagenesis kit, Catalog #200524, Stratagene, La Jolla, Calif.). Primer design for target sites for mutagenesis is well-known in the art, and multiple sequence alignment to identify the target sites is likewise well-known.

Once variants have been generated, KARI activity with NADH or NADPH can be readily assessed using methods known in the art and/or disclosed herein. For example, KARI activity can be determined by measuring the disappearance of the NADPH or NADH from the reaction at 340 nm or by determination of the Michaelis constant via measurement of formation of 2,3-dihydroxyisovalerate using HPLC/MS. Likewise, isobutanol production from a strain comprising variants can be confirmed.

Cofactor Specificity

To determine cofactor specificity, $V_{max}/K_M$ ratios can be calculated for each cofactor at saturating acetolactate; those variants with a higher ratio for NADH will react at a higher rate with NADH than NADPH under conditions of equal-molar concentrations of the two cofactors and saturating acetolactate. $V_{max}$ and $K_M$ values for NADH and NADPH can be determined using methods known in the art and/or provided herein (see Example 16). For example, to determine $V_{max}$ and $K_M$ values for NADH and NADPH, the partially purified proteins can be assayed at various concentrations of NADH and NADPH.

Figure 8:
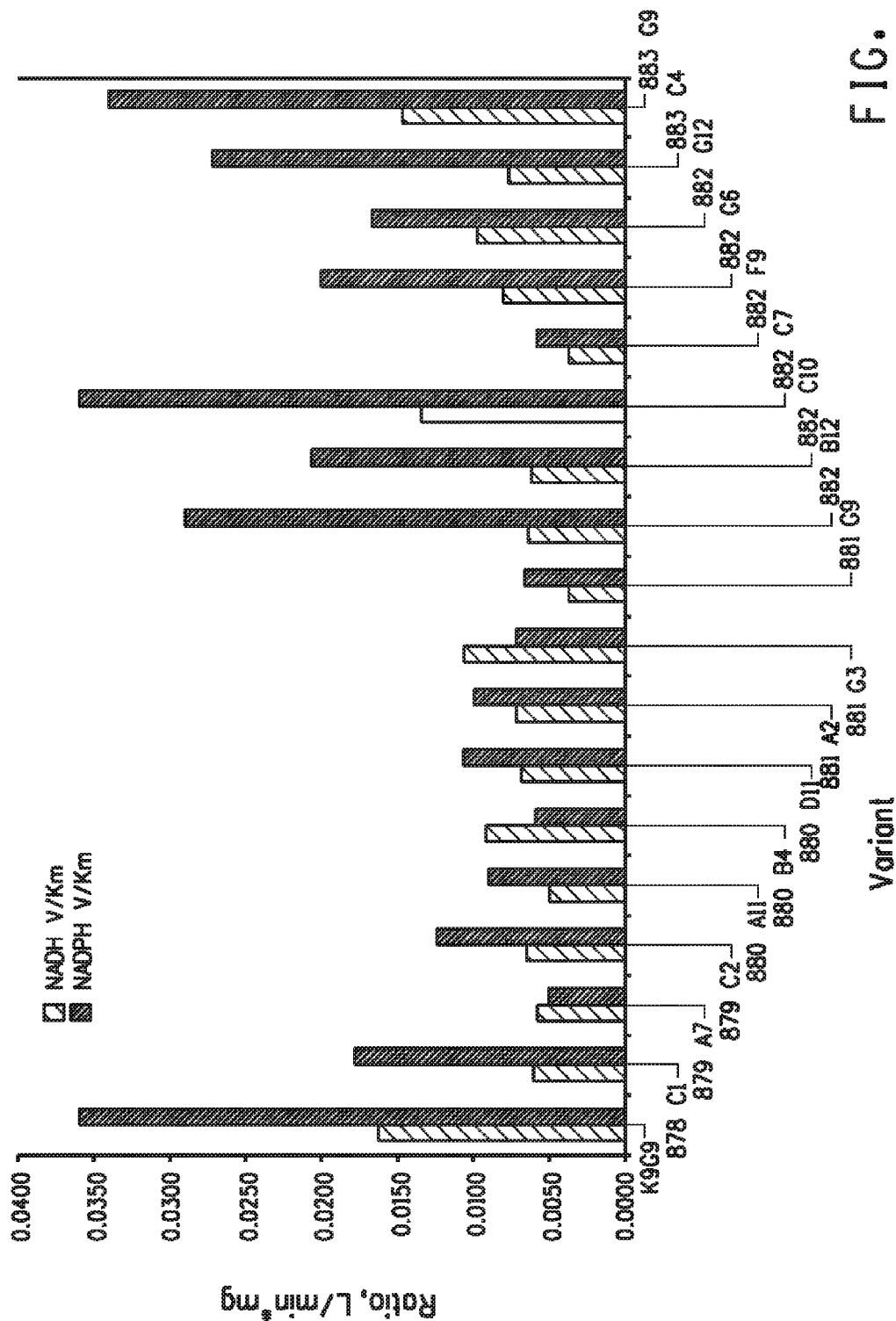
FIG. 8 shows a summary of $V_{max}/K_M$ values for K9G9 variants as described in Example 16.

As demonstrated herein (see Examples 16 and 18 and FIG. 8), substitution of additional amino acids in K9G9 results in variants having increased specificity for NADH. Thus, provided herein are polypeptides comprising substitution at one or more or all of the positions corresponding to K57, Y53, and E74 of K9 KARI (SEQ ID NO: 27). Also provided herein are polypeptides comprising substitutions at one or more or all of the positions corresponding to Y53, K57, E74, N87 and K90, In embodiments, the substitution at the position corresponding to Y53 is F. In embodiments, the substitution at the position corresponding to K57 is E. In embodiments, the substitution at the position corresponding to E74 is G. In embodiments, the substitution at the position corresponding to N87 is P. In embodiments, the substitution at the position corresponding to K90 is M or L. In embodiments, the variants comprise substitutions of at least one position corresponding to S56 or S58 of SEQ ID NO: 27 and further comprise at least one, at least two, at least three, or more than three further substitution(s) corresponding to positions of SEQ ID NO: 27 identified herein.

In embodiments, the polypeptides comprise fewer than 2, 3, 4, 5, 10, 15, or 20 substitutions with respect to the wild-type sequence. In embodiments, the polypeptides match the Profile HMM based on experimentally verified KARIs and given in Table Z with an E value less than <10$^{-3}$.

As demonstrated in the Examples, variants of K9SB2 (SEQ ID NO: 427) were generated and screened for variants with reduced NADPH affinity, revealing additional positions for substitution. Thus, in embodiments, polypeptides further comprise substitutions at one or more positions corresponding to F53, G55, A56, W59, F67, I84, L85, Q91, M94, and P135 of SEQ ID NO: 427. In embodiments, the substitution at position G55 is D or C, the substitution at position Q91 is L, the substitution at position A56 is T or V, the substitution at P135 is S, the substitution at position F53 is L, the substitution at position M94 is I, the substitution at position F67 is L or I, the substitution at position W59 is C, the substitution at position I84 is L, and the substitution at position L85 is M.

KARI Structure

Structural information useful in the identification and modification of polypeptides having KARI activity is provided in art, such as in the references described here as well as in the Profile HMM provided herewith in Table Z and in US App. Pub. Nos. 20100197519 and 20090163376, incorporated herein by reference It was reported that phosphate p2' oxygen atoms of NADPH form hydrogen bonds with side chains of Arg162, Ser165 and Ser167 of spinach KARI (Biou V., et al. The EMBO Journal, 16: 3405-3415, 1997). Studies by Ahn et al., (J. Mol. Biol., 328: 505-515, 2003) had identified three NADPH phosphate binding sites (Arg47, Ser50 and Thr52) for *Pseudomonas aeruginosa* (PAO-KARI) following comparing its structure with that of the spinach KARI. The structure of PF5-KARI with bound NADPH, acetolactate and magnesium ions was built based on the crystal structure of *P. aeruginosa* PAO1-KARI (PDB ID 1NP3, Ahn H. J. et al., J. Mol. Biol., 328: 505-515, 2003) which has 92% amino acid sequence homology to PF5 KARI. PAO1-KARI structure is a homo-dodecamer and each dodecamer consists of six homo-dimers with extensive dimer interface. The active site of KARI is located in this dimer interface. The biological assembly is formed by six homo-dimers positioned on the edges of a tetrahedron resulting in a highly symmetrical dodecamer of 23 point group symmetry.

The model of PF5-KARI dimer was built based on the coordinates of monomer A and monomer B of PAO1-KARI and sequence of PF5-KARI using DeepView/Swiss PDB viewer (Guex. N. and Peitsch, M. C., Electrophoresis, 18: 2714-2723, 1997). This model was then imported to program O (Jones, T. A. et al, Acta Crystallogr. A 47: 110-119, 1991) on a Silicon Graphics system for further modification.

The structure of PAO1-KARI has no NADPH, substrate or inhibitor or magnesium in the active site. Therefore, the spinach KARI structure (PDB ID 1yve, Biou V. et al., The EMBO Journal, 16: 3405-3415, 1997), which has magnesium ions, NADPH and inhibitor (N-Hydroxy-N-isopropyloxamate) in the acetolactate binding site, was used to model these molecules in the active site. The plant KARI has very little sequence homology to either PF5- or PAO1 KARI (<20% amino acid identity), however the structures in the active site region of these two KARI enzymes are very similar. To overlay the active site of these two KARI structures, commands LSQ_ext, LSQ_improve, LSQ_mol in the program O were used to line up the active site of monomer A of spinach KARI to the monomer A of PF5 KARI model. The coordinates of NADPH, two magnesium ions and the inhibitor bound in the active site of spinach KARI were extracted and incorporated to molecule A of PF5 KARI. A set of the coordinates of these molecules were generated for monomer B of PF5 KARI by applying the transformation operator from monomer A to monomer B calculated by the program.

Because there is no NADPH in the active site of PAO1 KARI crystal structure, the structures of the phosphate binding loop region in the NADPH binding site (residues 44-45 in PAO1 KARI, 157-170 in spinach KARI) are very different between the two. To model the NADPH bound form, the model of the PF5-KARI phosphate binding loop (44-55) was replaced by that of 1yve (157-170). Any discrepancy of side chains between these two was converted to those in the PF5-KARI sequence using the mutate_replace command in program O, and the conformations of the replaced side-chains were manually adjusted. The entire NADPH/Mg/inhibitor bound dimeric PF5-KARI model went through one round of energy minimization using program CNX (ACCELRYS San Diego Calif. Burnger, A. T. and Warren, G. L., Acta Crystallogr., D 54: 905-921, 1998) after which the inhibitor was replaced by the substrate, acetolactate (AL), in the model.

Isobutanol Production

Host cells provided herein can comprise a polypeptide having ketol-acid reductoisomerase activity. As described and demonstrated herein, Applicants have discovered additional KARI enzymes and variants of the additional KARIs that result in isobutanol production comparable to and/or exceeding that observed with the KARI from *Lactococcus lactis* (see Examples). Accordingly, in embodiments, polypeptides having KARI activity that function in an isobutanol production pathway have effective isobutanol productivity and/or produce isobutanol at a titer comparable to or better than that with the *Lactococcus lactis* KARI (SEQ ID NO: 380). Such polypeptides are thus considered to be useful for isobutanol production, particularly in cells comprising isobutanol production pathways described herein. In embodiments, polypeptides provided herein have effective isobutanol productivity and/or produce isobutanol at a titer greater than or about equal to that observed with the *Lactococcus lactis* KARI (SEQ ID NO: 380) under the same conditions. In embodiments, polypeptides provided herein have effective isobutanol productivity greater than about 3 grams per gram of cells, greater than about 4, greater than about 5, or greater than about 6 grams per gram of cells after about 48 hours wherein at least the last about 24 hours of the 48 hours are under anaerobic conditions.

Furthermore, Applicants have discovered that variants of the polypeptides having KARI activity described above, including those with $K_M$ for NADH lower than that of the unsubstituted polypeptide, provide advantages for isobutanol production under anaerobic conditions. While not wishing to be bound by theory, it is believed that such variants provide improved isobutanol production due to more effective use of NADH as reducing equivalents. In embodiments, isobutanol production employing such a variant provides reduced glycerol accumulation. In embodiments, the molar ratio of isobutanol to glycerol is increased for a variant of a polypeptide having KARI activity described above with $K_M$ for NADH lower than that of the unsubstituted polypeptide. In embodiments, the molar ratio of isobutanol to glycerol is greater than 1. In embodiments, the molar ratio of isobutanol to glycerol is greater than 2. In embodiments, the molar ratio is greater than 3. In embodiments, the molar ratio is greater than 4, greater than 5, greater than 6, greater than 7, greater than 8, greater than 9, greater than 10, greater than 12, or greater than 14. In embodiments, the molar ratio is in the range of about 1 to 5, about 1 to 10, about 2 to 8, about 5 to 10, about 5 to 15 about 10 to 15 or about 12 to 15.

As demonstrated in the Examples herein, as the biochemical specificity for the NADH cofactor, as defined by (NADH $V_{max}/K_M$)/(NADPH $V_{max}/K_M$) increases, there is an observed increase in the isobutanol/glycerol ratio, suggesting that the altered cofactor specificity led to diminished NADPH utilization and by-product formation.

Modification of Aldehyde Dehydrogenase

In embodiments of the invention, a recombinant host cell can comprise reduced or eliminated aldehyde dehydrogenase activity and an isobutanol biosynthetic pathway wherein the host cell produces butanol. In other embodiments, the recombinant host cell can comprise an isobutanol or a 1-butanol biosynthetic pathway as described further herein. In other embodiments, the isobutanol biosynthetic pathway can comprise a polynucleotide encoding a polypeptide that catalyzes a substrate to product conversion selected from the group consisting of: (a) pyruvate to acetolactate; (b) acetolactate to 2,3-dihydroxyisovalerate; (c) 2,3-dihydroxyisovalerate to 2-ketoisovalerate; (d) 2-ketoisovalerate to isobutyraldehyde; and (e) isobutyraldehyde to isobutanol. In other embodiments, the isobutanol biosynthetic pathway can comprise polynucleotides encoding polypeptides having acetolactate synthase, keto acid reductoisomerase, dihydroxy acid dehydratase, ketoisovalerate decarboxylase, and alcohol dehydrogenase activity. In other embodiments, the recombinant cell comprises a 1-butanol biosynthetic pathway. In other embodiments, the 1-butanol biosynthetic pathway comprises a polynucleotide encoding a polypeptide that catalyzes a substrate to product conversion selected from the group consisting of: (a) acetyl-CoA to acetoacetyl-CoA; (b) acetoacetyl-CoA to 3-hydroxybutyryl-CoA; (c) 3-hydroxybutyryl-CoA to crotonyl-CoA; (d) crotonyl-CoA to butyryl-CoA; (e) butyryl-CoA to butyraldehyde; (f) butyraldehyde to 1-butanol. In other embodiments, the 1-butanol biosynthetic pathway can comprise polynucleotides encoding polypeptides having activity.

In embodiments of the invention, a recombinant host cell can comprise a modification or disruption of a polynucleotide or gene encoding a polypeptide having aldehyde dehydrogenase activity or a modification or disruption of a polypeptide having aldehyde dehydrogenase activity. Many methods for genetic modification and disruption of target genes to reduce or eliminate expression are known to one of ordinary skill in the art and can be used to create a recombinant host cell disclosed herein. In other embodiments, the recombinant host cell can comprise a deletion, mutation, and/or substitution in an endogenous polynucleotide or gene encoding a polypeptide having aldehyde dehydrogenase activity or in an endogenous polypeptide having aldehyde dehydrogenase activity. Such modifications, disruptions, deletions, mutations, and/or substitutions can result in aldehyde dehydrogenase activity that is reduced or eliminated. Modifications that can be used include, but are not limited to, deletion of the entire gene or a portion of the gene encoding an aldehyde dehydrogenase protein, inserting a DNA fragment into the encoding gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less active protein is expressed. In other embodiments, expression of a target gene can be blocked by expression of an antisense RNA or an interfering RNA, and constructs can be introduced that result in cosuppression. In other embodiments, the synthesis or stability of the transcript can be lessened by mutation. In embodiments, the efficiency by which a protein is translated from mRNA can be modulated by mutation. All of these methods can be readily practiced by one skilled in the art making use of the known or identified sequences encoding target proteins.

In other embodiments, DNA sequences surrounding a target aldehyde dehydrogenase coding sequence are also useful in some modification procedures and are available, for example, for yeasts such as Saccharomyces cerevisiae in the complete genome sequence coordinated by Genome Project ID9518 of Genome Projects coordinated by NCBI (National Center for Biotechnology Information) with identifying GOPID #13838. An additional non-limiting example of yeast genomic sequences is that of Candida albicans, which is included in GPID #10771, #10701 and #16373. Other yeast genomic sequences can be readily found by one of skill in the art in publicly available databases.

In other embodiments, DNA sequences surrounding a target aldehyde dehydrogenase coding sequence can be useful for modification methods using homologous recombination. In a non-limiting example of this method, aldehyde dehydrogenase gene flanking sequences can be placed bounding a selectable marker gene to mediate homologous recombination whereby the marker gene replaces the aldehyde dehydrogenase gene. In another non-limiting example, partial aldehyde dehydrogenase gene sequences and aldehyde dehydrogenase gene flanking sequences bounding a selectable marker gene can be used to mediate homologous recombination whereby the marker gene replaces a portion of the target aldehyde dehydrogenase gene. In embodiments, the selectable marker can be bounded by site-specific recombination sites, so that following expression of the corresponding site-specific recombinase, the resistance gene is excised from the aldehyde dehydrogenase gene without reactivating the latter. In embodiments, the site-specific recombination leaves behind a recombination site which disrupts expression of the aldehyde dehydrogenase protein. In other embodiments, the homologous recombination vector can be constructed to also leave a deletion in the aldehyde dehydrogenase gene following excision of the selectable marker, as is well known to one skilled in the art.

In other embodiments, deletions can be made to an aldehyde dehydrogenase target gene using mitotic recombination as described by Wach et al, (Yeast, 10:1793-1808; 1994). Such a method can involve preparing a DNA fragment that contains a selectable marker between genomic regions that can be as short as 20 bp, and which bound a target DNA sequence. In other embodiments, this DNA fragment can be prepared by PCR amplification of the selectable marker gene using as primers oligonucleotides that hybridize to the ends of the marker gene and that include the genomic regions that can recombine with the yeast genome. In embodiments, the linear DNA fragment can be efficiently transformed into yeast and recombined into the genome resulting in gene replacement including with deletion of the target DNA sequence (((as disclosed, for example, in Methods in Enzymology, Volume 194, Guide to Yeast Genetics and Molecular and Cell Biology (Part A, 2004, Christine Guthrie and Gerald R. Fink (Eds.), Elsevier Academic Press, San Diego, Calif.)).

Moreover, promoter replacement methods can be used to exchange the endogenous transcriptional control elements allowing another means to modulate expression such as described by Mnaimneh et al., ((2004) Cell 118(1):31-44).

In other embodiments, the aldehyde dehydrogenase target gene encoded activity can be disrupted using random mutagenesis, which can then be followed by screening to identify strains with reduced or substantially eliminated activity. In this type of method, the DNA sequence of the target gene encoding region, or any other region of the genome affecting carbon substrate dependency for growth, need not be known. In embodiments, a screen for cells with reduced aldehyde dehydrogenase activity, or other mutants having reduced aldehyde dehydrogenase activity, can be useful for recombinant host cells of the invention.

Methods for creating genetic mutations are common and well known in the art and can be applied to the exercise of creating mutants. Commonly used random genetic modification methods (reviewed in Methods in Yeast Genetics, 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of host cells can involve, but is not limited to, treatment with one of the following DNA mutagens: ethyl methanesulfonate (EMS), nitrous acid, diethyl sulfate, or N-methyl-N'-nitro-N-nitroso-guanidine (MNNG). Such methods of mutagenesis have been reviewed in Spencer et al. (Mutagenesis in Yeast, 1996, Yeast Protocols: Methods in Cell and Molecular Biology. Humana Press, Totowa, N.J.). In embodiments, chemical mutagenesis with EMS can be performed as disclosed in Methods in Yeast Genetics, 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer et al. (Mutagenesis in Yeast, 1996, Yeast Protocols: Methods in Cell and Molecular Biology. Humana Press, Totowa, N.J.). In embodiments, the introduction of a mutator phenotype can also be used to generate random chromosomal mutations in host cells. In embodiments, common mutator phenotypes can be obtained through disruption of one or more of the following genes: PMS1, MAG1, RAD18 or RAD51. In other embodiments, restoration of the non-mutator phenotype can be obtained by insertion of the wildtype allele. In other embodiments, collections of modified cells produced from any of these or other known random mutagenesis processes can be screened for reduced or eliminated aldehyde dehydrogenase activity.

Genomes have been completely sequenced and annotated and are publicly available for the following yeast strains: Ashbya gossypii ATCC 10895, Candida glabrata CBS 138, Kluyveromyces lactis NRRL Y-1140, Pichia stipitis CBS 6054, Saccharomyces cerevisiae S288c, Schizosaccharomyces pombe 972h-, and Yarrowia lipolytica CLIB122. Typically BLAST (described above) searching of publicly available databases with known aldehyde dehydrogenase polynucleotide or polypeptide sequences, such as those provided herein, is used to identify aldehyde dehydrogenase-encoding sequences of other host cells, such as yeast cells.

In other embodiments, a polypeptide having aldehyde dehydrogenase activity can catalyze the conversion of isobutyraldehyde to isobutyric acid. In other embodiments, the conversion of isobutyraldehyde to isobutyric acid in a recombinant host cell is reduced or eliminated. In still other embodiments, a polynucleotide, gene or polypeptide having aldehyde dehydrogenase activity can correspond to Enzyme Commission Number EC 1.2.1.3, EC 1.2.1.4, and/or EC 1.2.1.5.

In embodiments, a recombinant host cell of the invention can be S. cerevisiae, and a polypeptide having aldehyde dehydrogenase activity can be ALD2, ALD3, ALD4, ALD5, ALD6, or combinations thereof. In other embodiments, a recombinant host cell can be Kluyveromyces lactis, and a polypeptide having aldehyde dehydrogenase activity can be KLLA0F00440, KLLA0E23057, KLLA0D10021, KLLA0D09999G, or combinations thereof. In other embodiments, a recombinant host cell can be *Pichia stipitis*, and a polypeptide having aldehyde dehydrogenase activity can ALD2, ALD3, ALD4, ALD5, ALD7, or combinations thereof. In other embodiments, a recombinant host cell can be *Lactobacillus plantarum*, and a polypeptide having aldehyde dehydrogenase activity can be AldH. In other embodiments, a recombinant host cell can be *E. coli*, and a polypeptide having aldehyde dehydrogenase activity can be aldA, aldB, aldH, or combinations thereof.

In embodiments of the invention, a recombinant host cell can be *S. cerevisiae*, and an endogenous polynucleotide or gene encoding a polypeptide having aldehyde dehydrogenase activity can be ALD2, ALD3, ALD4, ALD5, ALD6, or combinations thereof. In embodiments of the invention, a recombinant host cell can be *S. cerevisiae*, and an endogenous polynucleotide or gene encoding a polypeptide having aldehyde dehydrogenase activity can be ALD6. In other embodiments, a recombinant host cell can be *Kluyveromyces lactis*, and an endogenous polynucleotide or gene encoding a polypeptide having aldehyde dehydrogenase activity can be KLLA0F00440, KLLA0E23057, KLLA0D10021, KLLA0D09999G, or combinations thereof. In other embodiments, a recombinant host cell can be *Pichia stipitis*, and an endogenous polynucleotide or gene encoding a polypeptide having aldehyde dehydrogenase activity can be ALD2, ALD3, ALD4, ALD5, ALD7, or combinations thereof. In embodiments, the polypeptide having aldehyde dehydrogenase activity is a homolog of ALD6 from *Saccharomyces cerevisiae*. *S. cerevisiae* deletion strains containing aldehyde dehydrogenase gene deletions with a kanMX cassette are commercially available from American Type Culture Collection [catalog #4000753].

In other embodiments, a recombinant host cell can be *Lactobacillus plantarum*, and an endogenous polynucleotide encoding a polypeptide having aldehyde dehydrogenase activity can be AldH. In other embodiments, a recombinant host cell can be *E. coli*, and an endogenous polynucleotide encoding a polypeptide having aldehyde dehydrogenase activity can be aldA, aldB, aldH, or combinations thereof.

Examples of aldehyde dehydrogenase polynucleotides, genes and polypeptides that can be targeted for modification or inactivation in a recombinant host cell disclosed herein include, but are not limited to, those of the following Table 4.

TABLE 4

Aldehyde dehydrogenase target gene coding regions and proteins.

| | Nucleic acid SEQ ID NO: | Amino acid SEQ ID NO: |
|---|---|---|
| ALD2 from *S. cerevisiae* | 732 | 733 |
| ALD3 from *S. cerevisiae* | 734 | 735 |
| ALD4 from *S. cerevisiae* | 736 | 737 |
| ALD5 from *S. cerevisiae* | 738 | 739 |
| ALD6 from *S. cerevisiae* | 740 | 741 |
| KLLA0F00440 from *Kluyveromyces lactis* | 742 | 743 |
| KLLA0E23057 from *Kluyveromyces lactis* | 744 | 745 |
| KLLA0D10021 from *Kluyveromyces lactis* | 746 | 747 |
| KLLA0D09999 from *Kluyveromyces lactis* | 748 | 749 |
| ALD2 from *Pichia stipits* | 750 | 751 |
| ALD3 from *Pichia stipitis* | 752 | 753 |
| ALD4 from *Pichia stipitis* | 754 | 755 |
| ALD5 from *Pichia stipitis* | 756 | 757 |
| ALD7 from *Pichia stipitis* | 758 | 759 |
| aldA from *E. coli* | 760 | 761 |
| aldB from *E. coli* | 762 | 763 |
| aldH (puuC) from *E. coli* | 764 | 765 |

Other examples of aldehyde dehydrogenase polynucleotides, genes and polypeptides that can be targeted for modification or inactivation in a recombinant host cell disclosed herein include, but are not limited to, aldehyde dehydrogenase polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 4, wherein such a polynucleotide or gene encodes, or such a polypeptide has, aldehyde dehydrogenase activity. Still other examples of aldehyde dehydrogenase polynucleotides, genes and polypeptides that can be targeted for modification or inactivation in a recombinant host cell disclosed herein include, but are not limited to an active variant, fragment or derivative of any one of the sequences of Table 4, wherein such a polynucleotide or gene encodes, or such a polypeptide has, aldehyde dehydrogenase activity.

In embodiments, the sequences of other aldehyde dehydrogenase polynucleotides, genes and/or polypeptides can be identified in the literature and in bioinformatics databases well known to the skilled person using sequences disclosed herein and available in the art. For example, such sequences can be identified through BLAST searching of publicly available databases with known aldehyde dehydrogenase-encoding polynucleotide or polypeptide sequences. In such a method, identities can be based on the Clustal W method of alignment using the default parameters of GAP PENALTY=10, GAP LENGTH PENALTY=0.1, and Gonnet 250 series of protein weight matrix.

Additionally, the aldehyde dehydrogenase polynucleotide or polypeptide sequences disclosed herein or known the art can be used to identify other aldehyde dehydrogenase homologs in nature. For example, each of the aldehyde dehydrogenase encoding nucleic acid fragments disclosed herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies [e.g., polymerase chain reaction (PCR). Mullis et al., U.S. Pat. No. 4,683,202; ligase chain reaction (LCR), Tabor et al., *Proc. Acad. Sci.* USA 82:1074 (1985); or strand displacement amplification (SDA), Walker et al., *Proc. Natl. Acad. Sci.* U.S.A., 89:392 (1992)]; and (3) methods of library construction and screening by complementation.

Accordingly, it is within the scope of the invention to provide aldehyde dehydrogenase polynucleotides, genes and polypeptides having at least about 70% to about 75%, about 75% to about 80%, about 80% to about 85%, about 85% to about 90%, about 90% to about 95%, about 96%, about 97%, about 98%, or about 99% sequence identity to any of the aldehyde dehydrogenase polynucleotides or polypeptides disclosed herein (e.g., SEQ ID NOs: 732-765 of Table 4)

Identities are based on the Clustal W method of alignment using the default parameters of GAP PENALTY=10, GAP LENGTH PENALTY=0.1, and Gonnet 250 series of protein weight matrix.

The modification of aldehyde dehydrogenase in a recombinant host cell disclosed herein to reduce or eliminate aldehyde dehydrogenase activity can be confirmed using methods known in the art. For example, disruption of a particular aldehyde dehydrogenase could be confirmed with PCR screening using primers internal and external to the aldehyde dehydrogenase gene or by Southern blot using a probe designed to the aldehyde dehydrogenase gene sequence. Alternatively, one could utilize gas chromatography-mass spectroscopy or liquid chromatography to screen strains exposed to isobutyraldehyde for decreased formation of isobutyric acid. Accordingly, provided herein is a method of screening for strains with decreased isobutyric acid formation comprising: a) providing a strain comprising a modification in a polynucleotide encoding a polypeptide having aldehyde dehydrogenase activity and/or a modification in a polynucleotide encoding a polypeptide having aldehyde oxidase activity; b) contacting the cell with isobutyraldehyde; and c) measuring isobutyric acid formation; wherein isobutyric acid formation is reduced as compared to a control strain without the modification. In some embodiments, the modification is a deletion, mutation, and/or substitution. In some embodiments, the measuring is carried out using gas chromatography-mass spectroscopy. In some embodiments, isobutyric acid is reduced by at least about 10%, at least 20%, at least 30%, at least 40%, at least 50%, at least 60%, at least 70%, at least 80%, or at least 90%. In some embodiments, isobutyric acid formation is substantially eliminated.

Modification of Aldehyde Oxidase

In embodiments of the invention, a recombinant host cell disclosed herein can have a modification or disruption of a polynucleotide, gene or polypeptide encoding aldehyde oxidase. In embodiments, the recombinant host cell comprises a deletion, mutation, and/or substitution in an endogenous polynucleotide or gene encoding a polypeptide having aldehyde oxidase activity, or in an endogenous polypeptide having aldehyde oxidase activity. Such modifications, disruptions, deletions, mutations, and/or substitutions can result in aldehyde oxidase activity that is reduced or eliminated.

In embodiments of the invention, a polypeptide having aldehyde oxidase activity can catalyze the conversion of isobutyraldehyde to isobutyric acid. In other embodiments, the conversion of isobutyraldehyde to isobutyric acid in a recombinant host cell is reduced or eliminated. In other embodiments, a polynucleotide, gene or polypeptide having aldehyde oxidase activity can correspond to Enzyme Commission Number EC 1.2.3.1.

In embodiments, a recombinant host cell of the invention can be *Pichia stipitis* and a polynucleotide, gene or polypeptide having aldehyde oxidase activity can be AOX1 and/or AOX2.

Examples of aldehyde oxidase polynucleotides, genes and polypeptides that can be targeted for modification or inactivation in a recombinant host cell disclosed herein include, but are not limited to, those of the following Table 5.

TABLE 5

Aldehyde oxidase target gene coding regions and proteins.

| | Nucleic acid SEQ ID NO: | Amino acid SEQ ID NO: |
|---|---|---|
| AOX1 from *Pichia stipitis* | 864 | 866 |
| AOX2 from *Pichia stipitis* | 867 | 868 |

Other examples of aldehyde oxidase polynucleotides, genes and polypeptides that can be targeted for modification or inactivation in a recombinant host cell disclosed herein include, but are not limited to, aldehyde oxidase polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 5, wherein such a polynucleotide or gene encodes a polypeptide having, or such a polypeptide has, aldehyde oxidase activity. Still other examples of aldehyde oxidase polynucleotides, genes and polypeptides that can be targeted for modification or inactivation in a recombinant host cell disclosed herein include, but are not limited to an active variant, fragment or derivative of any one of the sequences of Table 5, wherein such a polynucleotide or gene encodes, or such a polypeptide has, aldehyde oxidase activity.

In embodiments, a polynucleotide, gene and/or polypeptide encoding an aldehyde oxidase sequence disclosed herein or known in the art can be modified, as disclosed above for acetolactate reductase or aldehyde dehydrogenase. In other embodiments, a polynucleotide, gene and/or polypeptide encoding aldehyde oxidase can be used to identify another aldehyde oxidase polynucleotide, gene and/or polypeptide sequence and/or can be used to identify an aldehyde oxidase homolog in other cells, as disclosed above for aldehyde dehydrogenase. Such aldehyde oxidase encoding sequences can be identified, for example, in the literature and/or in bioinformatics databases well known to the skilled person. For example, the identification of an aldehyde oxidase encoding sequence in another cell type using bioinformatics can be accomplished through BLAST (as disclosed above) searching of publicly available databases with a known hexose kinase encoding DNA and polypeptide sequence, such as any of those provided herein. Identities are based on the Clustal W method of alignment using the default parameters of GAP PENALTY=10, GAP LENGTH PENALTY=0.1, and Gonnet 250 series of protein weight matrix.

The modification of aldehyde oxidase in a recombinant host cell disclosed herein to reduce or eliminate aldehyde oxidase activity can be confirmed using methods known in the art. For example, disruption of a particular aldehyde oxidase could be confirmed with PCR screening using primers internal and external to the aldehyde oxidase gene or by Southern blot using a probe designed to the aldehyde oxidase gene sequence. Alternatively, one could utilize gas chromatography or other analytical methods to screen strains exposed to isobutyraldehyde for decreased formation of isobutyric acid (as described and demonstrated in the Examples). In some embodiments, isobutyric acid is reduced by at least about 10%, at least 20%, at least 30%, at least 40%, at least 50%, at least 60%, at least 70%, at least 80%, or at least 90%. In some embodiments, isobutyric acid formation is substantially eliminated.

Applicants have provided recombinant host cells comprising reduced or eliminated aldehyde dehydrogenase and/or aldehyde oxidase activity. In embodiments, a recombinant host cell disclosed herein can further comprise a modification in a polynucleotide encoding a polypeptide having pyruvate decarboxylase activity and/or a modification in a polynucleotide encoding a polypeptide having hexokinase 2 activity. In embodiments, a recombinant host cell of the invention can produce a production of a biosynthetic pathway (e.g., isobutanol), and can comprise a polynucleotide encoding a polypeptide that catalyzes a substrate to product conversion selected from the group consisting of: (a) pyruvate to acetolactate; (b) acetolactate to 2,3-dihydroxyisovalerate; (c) 2,3-dihydroxyisovalerate to 2-ketoisovalerate; (d) 2-ketoisovalerate to isobutyraldehyde; and (e) isobutyraldehyde to isobutanol. In other embodiments, such a recombinant host cell can produce a product of a biosynthetic pathway (e.g., isobutanol) at a yield or amount that is greater than the yield or amount of the same product produced by a recombinant host cell that does not comprise reduced or eliminated aldehyde dehydrogenase activity and/or aldehyde oxidase activity. In other embodiments, a recombinant host cell of the invention can reduce or eliminate the conversion of isobutyraldehyde to isobutyric acid, and can be used for screening candidate polypeptides having aldehyde dehydrogenase and/or aldehyde oxidase activity. As such, Applicants have also provided methods of increasing the yield or titer of a product of a biosynthetic pathway (e.g., isobutanol), methods for reducing or eliminating the conversion of isobutyraldehyde to isobutyric acid, and methods for screening candidate polypeptides having aldehyde dehydrogenase and/or aldehyde oxidase activity.

In embodiments of the invention, methods of producing a recombinant host cell are provided which comprise (a) providing a recombinant host cell disclosed herein; and (b) transforming said host cell with a polynucleotide encoding a polypeptide of a biosynthetic pathway (e.g., an isobutanol biosynthetic pathway). In other embodiments, methods of producing a recombinant host cell are provided which comprise (a) providing a recombinant host cell comprising a modification in a polynucleotide encoding a polypeptide having aldehyde dehydrogenase activity or in a polypeptide having aldehyde dehydrogenase activity; and (b) transforming said host cell with a polynucleotide encoding a polypeptide of a biosynthetic pathway (e.g., an isobutanol biosynthetic pathway). In other embodiments, methods of producing a recombinant host cell are provided which comprise (a) providing a recombinant host cell comprising a modification in a polynucleotide encoding a polypeptide having aldehyde oxidase activity or in a polypeptide having aldehyde oxidase activity; and (b) transforming said host cell with a polynucleotide encoding a polypeptide of an isobutanol biosynthetic pathway.

In embodiments, methods for reducing or eliminating the conversion of isobutyraldehyde to isobutyric acid are provided which comprise (a) providing a recombinant host cell disclosed herein; and (b) growing said host cell under conditions wherein the conversion of isobutyraldehyde to isobutyric acid is reduced or eliminated compared to a recombinant host cell that does not comprise reduced or eliminated aldehyde dehydrogenase and/or aldehyde oxidase activity. The conversion of isobutyraldehyde to isobutyric acid of a recombinant host cell disclosed herein can be measured by methods known in the art (see, e.g., Methods in Yeast Genetics, 2005, Cold Spring Harbor Laboratory Press, Cold Spring Harbor, N.Y., pp. 201-202) and/or described herein.

Reduction of DHMB

The production of DHMB in a host cell comprising an isobutanol biosynthetic pathway indicates that not all of the pathway substrates are being converted to the desired product. Thus, yield is lowered. In addition, DHMB can have inhibitory effects on product production. For example, DHMB can decrease the activity of enzymes in the biosynthetic pathway or have other inhibitory effects on yeast growth and/or productivity during fermentation. Thus, the methods described herein provide ways of reducing DHMB during fermentation. The methods include both methods of decreasing the production of DHMB and methods of removing DHMB from fermenting compositions.

Decreasing DHMB Production

In some embodiments described herein, a recombinant host cell can comprise reduced or eliminated ability to convert acetolactate to DHMB. The ability of a host cell to convert acetolactate to DHMB can be reduced or eliminated, for example, by a modification or disruption of a polynucleotide or gene encoding a polypeptide having acetolactate reductase activity or a modification or disruption of a polypeptide having acetolactate reductase activity. In other embodiments, the recombinant host cell can comprise a deletion, mutation, and/or substitution in an endogenous polynucleotide or gene encoding a polypeptide having acetolactate reductase activity or in an endogenous polypeptide having acetolactate reductase. Such modifications, disruptions, deletions, mutations, and/or substitutions can result in acetolactate reductase activity that is reduced, substantially eliminated, or eliminated. In some embodiments of the invention, the product of the biosynthetic pathway is produced at a greater yield or amount compared to the production of the same product in a recombinant host cell that does not comprise reduced or eliminated ability to convert acetolactate to DHMB.

Thus, the product can be a composition comprising butanol that is substantially free of, or free of DHMB. In some embodiments, the composition comprising butanol contains no more than about 5 mM, about 4 mM, about 3 mM, about 2 mM, about 1 mM, about 0.5 mM, about 0.4 mM, about 0.3 mM DHMB, or about 0.2 mM DHMB.

The product can also be a composition comprising 2,3-butanediol (BDO) that is substantially free of, or free of DHMB. In some embodiments, the composition comprising BDO contains no more than about 5 mM, about 4 mM, about 3 mM, about 2 mM, about 1 mM, about 0.5 mM, about 0.4 mM, about 0.3 mM DHMB, or about 0.2 mM DHMB.

Any product of a biosynthetic pathway that involves the conversion of acetolactate to a substrate other than DHMB can be produced with greater effectiveness in a recombinant host cell disclosed herein having the described modification of acetolactate reductase activity. Such products include, but are not limited to, butanol, e.g., isobutanol, 2-butanol, and BDO, and branched chain amino acids.

In some embodiments, the host cell comprises at least one deletion, mutation, and/or substitution in at least one endogenous polynucleotide encoding a polypeptide having acetolactate reductase activity. In some embodiments, the host cell comprises at least one deletion, mutation, and/or substitution in each of at least two endogenous polynucleotides encoding polypeptides having acetolactate reductase activity.

In some embodiments, a polypeptide having acetolactate reductase activity can catalyze the conversion of acetolactate to DHMB. In some embodiments, a polypeptide having acetolactate reductase activity is capable of catalyzing the reduction of acetolactate to 2S,3S-DHMB (fast DHMB) and/or 2S,3R-DHMB (slow DHMB).

TABLE 6

Polypeptides and polynucleotides having acetolactate reductase activity in *Saccharomyces cerevisiae*

| Gene | SEQ ID NO: (nucleic acid, amino acid) |
|---|---|
| YMR226C | 676, 677 |
| YIL074C (Chr 9) | 678, 679 |
| YIR036C (Chr 9) | 680, 681 |
| YPL061W (ALD6)(Chr 16) | 682, 683 |
| YPL088W(Chr 16) | 684, 685 |
| YCR105W (ADH7)(Chr 3) | 686, 687 |
| YDR541C(Chr 4) | 688, 689 |
| YER081 (SER3)(Chr 5) | 690, 691 |
| YPL275W (FDH2)(Chr 16) | 692, 693 |
| YBR006W (UGA5)(Chr2) | 694, 695 |
| YOL059W(Chr 15) | 696, 697 |
| YER081W (Chr 5) | 869, 870 |
| YOR375C (Chr 15) | 871, 872 |

In some embodiments, the conversion of acetolactate to DHMB in a recombinant host cell is reduced, substantially eliminated, or eliminated. In some embodiments, the polypeptide having acetolactate reductase activity is selected from the group consisting of: YMR226C, YER081W, YIL074C, YBR006W, YPL275W, YOL059W, YIR036C, YPL061W, YPL088W, YCR105W, YOR375C, and YDR541C. In some embodiments, the polypeptide having acetolactate reductase activity is a polypeptide comprising a sequence listed in Table 6 or a sequence that is at least about 70%, at least about 75%, at least about 80%, at least about 85%, at least about 90%, at least about 95%, or at least about 99% identical to a polypeptide sequence listed in Table 6. In some embodiments, the polypeptide having acetolactate reductase activity is a polypeptide encoded by a polynucleotide sequence listed in Table 6 or a sequence that is at least about 70%, at least about 75%, at least about 80%, at least about 85%, at least about 90%, at least about 95%, or at least about 99% identical to a polynucleotide sequence listed in Table 6.

TABLE 7

Example YMR226C Yeast Homologs

| Species | Accession # | SEQ ID NO: (nucleic acid, amino acid) |
|---|---|---|
| *Saccharomyces paradoxus* | AABY01000127 | 698, 699 |
| *Saccharomyces bayanus* | AACA01000631 | 700, 701<br>MSQGRKAAERLANKTVLITGASA<br>GIGKATALEYLEASNGNMKLILAA<br>RRLEKLEELKKTIDEEFPNAKVH<br>VGQLDITQAEKIKPFIENLPEAFK<br>DIDILINNAGKALGSERVGEIATQ<br>DIQDVFDTNVTALINVTQAVLPIF<br>QAKNSGDIVNLGLGGRQRRIPH<br>RLHLLCFQVCRRCVH*QFEKGT<br>DQHEDQSYLDRAGAG*DRVLTG<br>QQR**GTS*KRLQGHYAVDGRR<br>RG*LNRIFHFQKAEHRGCRHPDL<br>PHQPSLALPHLSRL*<br>(SEQ ID NO: 701)<br>The sequence came from a comparative genomics study using "draft" genome sequences with 7-fold coverage (Kellis at al, Nature 423: 241-254 (2003)). |
| *Saccharomyces castellii* | AACF01000116 | 702, 703 |
| *Saccharomyces mikatae* | AACH01000019 | 704, 705 |
| *Ashbya gossypii* | AE016819 | 706, 707 |
| *Candida glabrata* | CR380959 | 708, 709 |
| *Debaryomyces hansenii* | CR382139 | 710, 711 |
| *Scheffersomyces stipitis* (formerly *Pichia stipitis*) | XM_001387479 | 712, 713 |
| *Meyerozyma guilliermondii* (formerly *Pichia guilliermondii*) | XM_00142184 | 714, 715 |
| *Vanderwaltozyma polyspora* (formerly *Kluyveromyces polysporus*) | XM_001645671 | 716, 717 |
| *Candida dubliniensis* | XM_002419771 | 718, 719 |
| *Zygosaccharomyces rouxii* | XM_002494574 | 720, 721 |

TABLE 7-continued

Example YMR226C Yeast Homologs

| Species | Accession # | SEQ ID NO: (nucleic acid, amino acid) |
|---|---|---|
| Lachancea thermotolerans (formerly Kluyveromyces thermotolerans) | XM_002553230 | 722, 723 |
| Kluyveromyces lactis | XM_451902 | 724, 725 |
| Saccharomyces kluyveri | SAKL0H04730 | 726, 727 |
| Yarrowia lipolytica | XM_501554 | 728, 729 |
| Schizosaccharomyces pombe | NM_001018495 | 730, 731 |

In some embodiments, a polypeptide having acetolactate reductase activity is YMR226C or a homolog of YMR226C. Thus, in some embodiments, the polypeptide having acetolactate reductase activity is a polypeptide comprising a sequence listed in Table 7 or a sequence that is at least about 70%, at least about 75%, at least about 80%, at least about 85%, at least about 90%, at least about 95%, or at least about 99% identical to a polypeptide sequence listed in Table 7. In some embodiments, the polypeptide having acetolactate reductase activity is a polypeptide encoded by a polynucleotide sequence listed in Table 7 or a sequence that is at least about 70%, at least about 75%, at least about 80%, at least about 85%, at least about 90%, at least about 95%, or at least about 99% identical to a polynucleotide sequence listed in Table 7. Acetolactate reductases capable of converting acetolactate to DHMB can be identified, for example, by screening genetically altered yeast for changes in acetolactate consumption, changes in DHMB production, changes in DHIV production, or changes in other downstream product (e.g., butanol) production.

One way of identifying a gene involved in DHMB production comprises measuring the amount of DHMB produced by individual yeast strains in a yeast knock-out library. Knock-out libraries are available, for example, from Open Biosystems® (a division of Thermo Fisher Scientific, Waltham, Mass.). In this method, a decrease in DHMB production indicates that the gene that has been knocked-out functions to increase DHMB production, and an increase in DHMB production indicates that the gene that has been knocked-out functions to decrease DHMB production.

Two ways that a knockout ("KO") library can be used to identify candidate genes for involvement in DHMB synthesis include: (1) DHMB and DHIV accumulated in the culture during growth from endogenous substrates (acetolactate and NADPH or NADH) can be analyzed in samples from cultures. These samples can be placed in a hot (80-100° C.) water bath for 10-20 min, or diluted into a solution such as 2% formic acid that will kill and permeabilize the cells. After either treatment, small molecules will be found in the supernatant after centrifugation (5 min, 1100×g). The DHMB/DHIV ratio of a control strain (e.g., BY4743) can be compared to that of the different KO derivatives, and the gene(s) missing from any strain(s) with exceptionally low DHMB/DHIV ratios can encode acetolactate reductase (ALR). (2) DHMB and/or DHIV formation rates in vitro from exogenous substrates (acetolactate and NADH and/or NADPH) can be measured in timed samples taken from a suspension of permeabilized cells, and inactivated in either of the ways described above. Since the substrates for DHMB and DHIV synthesis are the same, this allows one to measure the relative levels of ALR and KARI activity in the sample.

Another way of identifying a gene involved in DHMB production comprises measuring the amount of DHMB produced by individual yeast strains in a yeast overexpression library. Overexpression libraries are available, for example, from Open Biosystems® (a division of Thermo Fisher Scientific, Waltham, Mass.). In this method, a decrease in DHMB production indicates that the overexpressed gene functions to decrease DHMB production, and an increase in DHMB production indicates that the overexpressed gene functions to increase DHMB production.

Another way of identifying a gene involved in DHMB production is to biochemically analyze a DHMB-producing yeast strain. For example, DHMB-producing cells can be disrupted. This disruption can be performed at low pH and cold temperatures. The cell lysates can be separated into fractions, e.g., by adding ammonium sulfate or other techniques known to those of skill in the art, and the resulting fractions can be assayed for enzymatic activity. For example, the fractions can be assayed for the ability to convert acetolactate to DHMB. Fractions with enzymatic activity can be treated by methods known in the art to purify and concentrate the enzyme (e.g., dialysis and chromatographic separation). When a sufficient purity and concentration is achieved, the enzyme can be sequenced, and the corresponding gene encoding the acetolactate reductase capable of converting acetolactate to DHMB can be identified.

Furthermore, since the reduction of acetolactate to DHMB occurs in yeast, but does not occur to the same extent in E. coli, acetolactate reductases that are expressed in yeast, but not expressed in E. coli, can be selected for screening. Selected enzymes can be expressed in yeast or other protein expression systems and screened for the capability to convert acetolactate to DHMB.

Enzymes capable of catalyzing the conversion of acetolactate to DHMB can be screened by assaying for acetolactate levels, by assaying for DHMB levels, by assaying for DHIV levels, or by assaying for any of the downstream products in the conversion of DHIV to butanol, including isobutanol.

DHMB can be measured using any technique known to those of skill in the art. For example, DHMB can be separated and quantified by methods known to those of skill in the art and techniques described in the Examples provided herein. For example, DHMB can be separated and quantified using liquid chromatography-mass spectrometry, liquid chromatography-nuclear magnetic resonance (NMR), thin-layer chromatography, and/or HPLC with UV/Vis detection.

In embodiments, selected acetolactate reductase polynucleotides, genes and/or polypeptides disclosed herein can be modified or disrupted. Many suitable methods are known to those of ordinary skill in the art and include those described for aldehyde dehydrogenase (above).

The modification of acetolactate reductase in a recombinant host cell disclosed herein to reduce or eliminate acetolactate reductase activity can be confirmed using methods known in the art. For example, the presence or absence of an acetolactate reductase-encoding polynucleotide sequence can be determined using PCR screening. A decrease in acetolactate reductase activity can also be determined based on a reduction in conversion of acetolactate to DHMB. A decrease in acetolactate reductase activity can also be determined based on a reduction in DHMB production. A decrease in acetolactate reductase activity can also be determined based on an increase in butanol production.

Thus, in some embodiments, a yeast that is capable of producing butanol produces no more than about 5 mM, about 4 mM, about 3 mM, about 2 mM, about 1 mM, about 0.9 mM, about 0.8 mM, about 0.7 mM, about 0.6 mM, about 0.5 mM, about 0.4 mM or about 0.3 mM DHMB. In some embodiments, a yeast producing butanol produces no more than about 5 mM, about 4 mM, about 3 mM, about 2 mM, about 1 mM, about 0.9 mM, about 0.8 mM, about 0.7 mM, about 0.6 mM, about 0.5 mM, about 0.4 mM or about 0.3 mM DHMB. In some embodiments, a yeast producing butanol produces no more than about 0.2 mM or 0.2 mM DHMB.

In some embodiments, a yeast capable of producing butanol produces no more than about 10 mM DHMB when cultured under fermentation conditions for at least about 50 hours. In some embodiments, a yeast capable of producing butanol produces no more than about 5 mM DHMB when cultured under fermentation conditions for at least about 20 hours, at least about 25 hours, at least about 30 hours, at least about 35 hours, at least about 40 hours, at least about 45 hours, or at least about 50 hours. In some embodiments, a yeast capable of producing butanol produced no more than about 3 mM DHMB when cultured under fermentation conditions for at least about 5 hours, at least about 10 hours, at least about 15 hours, at least about 20 hours, at least about 25 hours, at least about 30 hours, at least about 35 hours, at least about 40 hours, at least about 45 hours, or at least about 50 hours. In some embodiments, a yeast capable of producing butanol produced no more than about 1 mM DHMB when cultured under fermentation conditions for at least about 1 hour, at least about 5 hours, at least about 10 hours, at least about 15 hours, at least about 20 hours, at least about 25 hours, at least about 30 hours, at least about 35 hours, at least about 40 hours, at least about 45 hours, or at least about 50 hours. In some embodiments, a yeast capable of producing butanol produced no more than about 0.5 mM DHMB when cultured under fermentation conditions for at least about 1 hour, at least about 5 hours, at least about 10 hours, at least about 15 hours, at least about 20 hours, at least about 25 hours, at least about 30 hours, at least about 35 hours, at least about 40 hours, at about 45 hours, or at least about 50 hours.

In some embodiments, a yeast comprising at least one deletion, mutation, and/or substitution in an endogenous polynucleotide encoding an acetolactate reductase produces no more than about 0.5 times, about 0.4 times, about 0.3 times, about 0.2 times, about 0.1 times, about 0.05 times the amount of DHMB produced by a yeast containing the endogenous polynucleotide encoding an acelotacate reductase when cultured under fermentation conditions for the same amount of time. In some embodiments, a yeast that is capable of producing butanol produces an amount of DHIV that is at least about 5 mM, at least about 6 mM, at least about 7 mM, at least about 8 mM, at least about 9 mM, or at least about 10 mM.

In some embodiments, a yeast that is capable of producing butanol produces an amount of DHIV that is at least about the amount of DHMB produced. In some embodiments, a yeast that is capable of producing butanol produces an amount of DHIV that is at least about twice, about three times, about five times, about ten times, about 15 times, about 20 times, about 25 times, about 30 times, about 35 times, about 40 times, about 45 times, or about 50 times the amount of DHMB produced. In some embodiments, a yeast that is capable of producing butanol produces DHIV at a rate that is at least about equal to the rate of DHMB production. In some embodiments, a yeast that is capable of producing butanol produces DHIV at a rate that is at least about twice, about three times, about five times, about ten times, about 15 times, about 20 times, about 25 times, about 30 times, about 35 times, about 40 times, about 45 times, or about 50 times the rate of DHMB production.

In some embodiments, a yeast that is capable of producing butanol produces less than 0.010 moles of DHMB per mole of glucose consumed. In some embodiments, a yeast produces less than about 0.009, less than about 0.008, less than about 0.007, less than about 0.006, or less than about 0.005 moles of DHMB per mole of glucose consumed. In some embodiments, a yeast produces less than about 0.004, less than about 0.003, less than about 0.002, or less than about 0.001 moles of DHMB per mole of glucose consumed.

In some embodiments, acetolactate reductase activity is inhibited by chemical means. For example, acetolactate reductase could be inhibited using other known substrates such as those listed in Fujisawa et al. including L-serine, D-serine, 2-methyl-DL-serine, D-threonine, L-allo-threonine, L-3-hydroxyisobutyrate, D-3-hydroxyisobutyrate, 3-hydroxypropionate, L-3-hydroxybutyrate, and D-3-hydroxybutyrate. Biochimica et Biophysica Acta 1645:89-94 (2003), which is herein incorporated by reference in its entirety.

DHMB Removal

In other embodiments described herein, a reduction in DHMB can be achieved by removing DHMB from a fermentation. Thus, fermentations with reduced DHMB concentrations are also described herein. Removal of DHMB can result, for example, in a product of greater purity, or a product requiring less processing to achieve a desired purity. Therefore, compositions comprising products of biosynthetic pathways such as ethanol or butanol with increased purity are also provided.

DHMB can be removed during or after a fermentation process and can be removed by any means known in the art. DHMB can be removed, for example, by extraction into an organic phase or reactive extraction.

In some embodiments, the fermentation broth comprises less than about 0.5 mM DHMB. In some embodiments, the fermentation broth comprises less than about 1.0 mM DHMB after about 5 hours, about 10 hours, about 15 hours, about 20 hours, about 25 hours, about 30 hours, about 35 hours, about 40 hours, about 45 hours, or about 50 hours of fermentation. In some embodiments, the fermentation broth comprises less than about 5.0 mM DHMB after about 20 hours, about 25 hours, about 30 hours, about 35 hours, about 40 hours, about 45 hours, or about 50 hours of fermentation.

Butanol Biosynthetic Pathways

Certain suitable isobutanol biosynthetic pathways are disclosed in U.S. Pat. Nos. 7,851,188 and 7,993,889, each of which is incorporated by reference herein. A diagram of the disclosed isobutanol biosynthetic pathways is provided in FIG. 1. As described in U.S. Pat. No. 7,851,188, steps in an example isobutanol biosynthetic pathway include conversion of:

pyruvate to acetolactate (see FIG. 1, pathway step a therein), as catalyzed for example by acetolactate synthase (ALS), acetolactate to 2,3-dihydroxyisovalerate (see FIG. 1, pathway step b therein) as catalyzed for example by acetohydroxy acid isomeroreductase (KARI);

2,3-dihydroxyisovalerate to 2-ketoisovalerate (see FIG. 1, pathway step c therein) as catalyzed for example by acetohydroxy acid dehydratase, also called dihydroxy-acid dehydratase (DHAD);

2-ketoisovalerate to isobutyraldehyde (see FIG. 1, pathway step d therein) as catalyzed for example by branched-chain 2-keto acid decarboxylase; and isobutyraldehyde to isobutanol (see FIG. 1, pathway step e therein) as catalyzed for example by branched-chain alcohol dehydrogenase.

In another embodiment, the isobutanol biosynthetic pathway comprises the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase;

2,3-dihydroxyisovalerate to α-ketoisovalerate, which may be catalyzed, for example, by dihydroxyacid dehydratase;

α-ketoisovalerate to valine, which may be catalyzed, for example, by transaminase or valine dehydrogenase;

valine to isobutylamine, which may be catalyzed, for example, by valine decarboxylase;

isobutylamine to isobutyraldehyde, which may be catalyzed by, for example, omega transaminase; and, isobutyraldehyde to isobutanol, which may be catalyzed, for example, by a branched-chain alcohol dehydrogenase.

In another embodiment, the isobutanol biosynthetic pathway comprises the following substrate to product conversions:

pyruvate to acetolactate, which may be catalyzed, for example, by acetolactate synthase;

acetolactate to 2,3-dihydroxyisovalerate, which may be catalyzed, for example, by acetohydroxy acid reductoisomerase;

2,3-dihydroxyisovalerate to α-ketoisovalerate, which may be catalyzed, for example, by acetohydroxy acid dehydratase;

α-ketoisovalerate to isobutyryl-CoA, which may be catalyzed, for example, by branched-chain keto acid dehydrogenase;

isobutyryl-CoA to isobutyraldehyde, which may be catalyzed, for example, by acetylating aldehyde dehydrogenase; and, isobutyraldehyde to isobutanol, which may be catalyzed, for example, by a branched-chain alcohol dehydrogenase.

In another embodiment, the isobutanol biosynthetic pathway comprises the substrate to product conversions shown as steps k, g, and e in FIG. 1.

Genes and polypeptides that can be used for the substrate to product conversions described above as well as those for additional isobutanol pathways, are described in U.S. Patent Appl. Pub. No. 2007/0092957 and PCT Pub. No. WO 2011/019894, both incorporated by reference herein. US Appl. Pub. Nos. 2011/019894, 200710092957, 2010/0081154, which are herein incorporated by reference, describe dihydroxyacid dehydratases including those from *Lactococcus lactis* and *Streptococcus mutans*. Ketoisovalerate decarboxylases include those derived from *Lactococcus lactis*, *Macrococcus caseolyticus* (SEQ ID NO: 542) and *Listeria grayi* (SEQ ID NO: 543). U.S. Patent Appl. Publ. No. 2009/0269823 and U.S. Appl. Publ. No. 2011/0269199, incorporated by reference, describe alcohol dehydrogenases, including those that utilize NADH as a cofactor. Alcohol dehydrogenases include SadB from *Achromobacter xylosoxidans*. Additional alcohol dehydrogenases include horse liver ADH and *Beijerinkia indica* ADH. Alcohol dehydrogenases include those that utilize NADH as a cofactor. In one embodiment a butanol biosynthetic pathway comprises a) a ketol-acid reductoisomerase that has a $K_M$ for NADH less than about 300 μM, less than about 100 μM, less than about 50 μM, less than about 20 μM or less than about 10 μM; b) an alcohol dehydrogenase that utilizes NADH as a cofactor; or c) both a) and b).

WO 2011/019894 and US Appl. Pub. Nos. 2011/019894, 2007/0092957, 2010/0081154, which are herein incorporated by reference in their entireties, describe suitable dihydroxyacid dehydratases. Methods of increasing DHAD activity are described, for example, in U.S. Patent Application Publication No. 2010/0081173 and U.S. patent application Ser. No. 13/029,558, filed Feb. 17, 2011, which are herein incorporated by reference in their entireties.

Suitable ketol-acid reductoisomerase (KARI) enzymes are described in U.S. Patent Appl. Pub. Nos. 2008/0261230 A1, 2009/0163376, 2010/0197519, 2010/0143997 and 2011/0244536, which are herein incorporated by reference in their entireties. Examples of KARIs disclosed therein are those from *Vibrio cholerae*, *Pseudomonas aeruginosa* PAO1, and *Pseudomonas fluorescens* PF5. In some embodiments, the KARI enzyme has a specific activity of at least about 0.1 micromoles/min/mg, at least about 0.2 micromoles/min/mg, at least about 0.3 micromoles/min/mg, at least about 0.4 micromoles/min/mg, at least about 0.5 micromoles/min/mg, at least about 0.6 micromoles/min/mg, at least about 0.7 micromoles/min/mg, at least about 0.8 micromoles/min/mg, at least about 0.9 micromoles/min/mg, at least about 1.0 micromoles/min/mg, or at least about 1.1 micromoles/min/mg. Suitable polypeptides to catalyze the substrate to product conversion acetolactate to 2,3-dihydroxyisovalerate include those that that have a KM for NADH less than about 300 μM, less than about 100 μM, less than about 50 μM, less than about 25 μM or less than about 10 μM.

In some embodiments, the KARI utilizes NADPH. Methods of measuring NADPH consumption are known in the art. For example, US Published Application No. 2008/0261230, which is herein incorporated by reference in its entirety, provides methods of measuring NADPH consumption. In some embodiments, an NADPH consumption assay is a method that measures the disappearance of the cofactor, NADPH, during the enzymatic conversion of acetolactate to α-β-dihydroxy-isovalerate at 340 nm. The activity is calculated using the molar extinction coefficient of 6220 $M^{-1}cm^{-1}$ for NADPH and is reported as μmole of NADPH consumed per min per mg of total protein in cell extracts (see Aulabaugh and Schloss, Biochemistry 29: 2824-2830, 1990).

In some embodiments, the KARI is capable of utilizing NADH. In some embodiments, the KARI is capable of utilizing NADH under anaerobic conditions. KARI enzymes using NADH are described, for example, in U.S. Patent Application Publication No. 2009/0163376, which is herein incorporated by reference in its entirety.

Additional genes that can be used can be identified by one skilled in the art through bioinformatics or using methods well-known in the art.

Additionally described in U.S. Patent Application Publication No. US 2007/0092957 A1, which is incorporated by reference herein, are construction of chimeric genes and genetic engineering of bacteria and yeast for isobutanol production using the disclosed biosynthetic pathways.

Biosynthetic pathways for the production of 1-butanol that may be used include those described in U.S. Appl. Pub. No. 2008/0182308, which is incorporated herein by reference. In one embodiment, the 1-butanol biosynthetic pathway comprises the following substrate to product conversions:
  a) acetyl-CoA to acetoacetyl-CoA, which may be catalyzed, for example, by acetyl-CoA acetyl transferase;
  b) acetoacetyl-CoA to 3-hydroxybutyryl-CoA, which may be catalyzed, for example, by 3-hydroxybutyryl-CoA dehydrogenase;
  c) 3-hydroxybutyryl-CoA to crotonyl-CoA, which may be catalyzed, for example, by crotonase;
  d) crotonyl-CoA to butyryl-CoA, which may be catalyzed, for example, by butyryl-CoA dehydrogenase;
  e) butyryl-CoA to butyraldehyde, which may be catalyzed, for example, by butyraldehyde dehydrogenase; and,
  f) butyraldehyde to 1-butanol, which may be catalyzed, for example, by butanol dehydrogenase.

Biosynthetic pathways for the production of 2-butanol that may be used include those described in U.S. Appl. Pub. No. 2007/0259410 and U.S. Appl. Pub. No. 2009/0155870, which are incorporated herein by reference. In one embodiment, the 2-butanol biosynthetic pathway comprises the following substrate to product conversions:
  a) pyruvate to alpha-acetolactate, which may be catalyzed, for example, by acetolactate synthase;
  b) alpha-acetolactate to acetoin, which may be catalyzed, for example, by acetolactate decarboxylase;
  c) acetoin to 3-amino-2-butanol, which may be catalyzed, for example, acetonin aminase;
  d) 3-amino-2-butanol to 3-amino-2-butanol phosphate, which may be catalyzed, for example, by aminobutanol kinase;
  e) 3-amino-2-butanol phosphate to 2-butanone, which may be catalyzed, for example, by aminobutanol phosphate phosphorylase; and,
  f) 2-butanone to 2-butanol, which may be catalyzed, for example, by butanol dehydrogenase.

In another embodiment, the 2-butanol biosynthetic pathway comprises the following substrate to product conversions:
  a) pyruvate to alpha-acetolactate, which may be catalyzed, for example, by acetolactate synthase;
  b) alpha-acetolactate to acetoin, which may be catalyzed, for example, by acetolactate decarboxylase;
  c) acetoin to 2,3-butanediol, which may be catalyzed, for example, by butanediol dehydrogenase;
  d) 2,3-butanediol to 2-butanone, which may be catalyzed, for example, by dial dehydratase; and,
  e) 2-butanone to 2-butanol, which may be catalyzed, for example, by butanol dehydrogenase.

In some embodiments of the invention, a recombinant host cell comprises a biosynthetic pathway. The biosynthetic pathway can comprise reduced or eliminated aldehyde dehydrogenase activity and an isobutanol or 1-butanol biosynthetic pathway wherein the pathway comprises the substrate to product conversion pyruvate to acetolactate. In some embodiments, a host cell comprising a biosynthetic pathway capable of converting pyruvate to acetolactate comprises a polynucleotide encoding a polypeptide having acetolactate synthase activity. For example, the biosynthetic pathway can be a butanol producing pathway or a butanediol producing pathway. The biosynthetic pathway can also be a branched-chain amino acid (e.g., leucine, isoleucine, valine) producing pathway.

In other embodiments, the recombinant host cell can comprise an isobutanol, 1-butanol, or a 2-butanol biosynthetic pathway as described herein. In some embodiments, the butanol biosynthetic pathway is an isobutanol biosynthetic pathway. Production of isobutanol or 2-butanol in a recombinant host cell disclosed herein may benefit from a reduction, substantial elimination or elimination of an acetolactate reductase activity.

Modifications

Functional deletion of the pyruvate decarboxylase gene has been used to increase the availability of pyruvate for utilization in biosynthetic product pathways. For example, U.S. Application Publication No. US 2007/0031950 A1, which is herein incorporated by reference in its entirety, discloses a yeast strain with a disruption of one or more pyruvate decarboxylase genes and expression of a D-lactate dehydrogenase gene, which is used for production of D-lactic acid. U.S. Application Publication No. US 2005/0059136 A1, which is herein incorporated by reference in its entirety, discloses glucose tolerant two carbon source independent (GCSI) yeast strains with no pyruvate decarboxylase activity, which can have an exogenous lactate dehydrogenase gene. Nevoigt and Stahl (*Yeast* 12:1331-1337 (1996)) describe the impact of reduced pyruvate decarboxylase and increased NAD-dependent glycerol-3-phosphate dehydrogenase in *Saccharomyces cerevisiae* on glycerol yield. U.S. Appl. Pub. No. 2009/0305363, which is herein incorporated by reference in its entirety, discloses increased conversion of pyruvate to acetolactate by engineering yeast for expression of a cytosol-localized acetolactate synthase and substantial elimination of pyruvate decarboxylase activity.

In embodiments of the invention, a recombinant host cell disclosed herein can comprise a modification in an endogenous polynucleotide encoding a polypeptide having pyruvate decarboxylase (PDC) activity or a modification in an endogenous polypeptide having PDC activity. In embodiments, a recombinant host cell disclosed herein can have a modification or disruption of a polynucleotide, gene and/or polypeptide encoding PDC. In embodiments, a recombinant host cell comprises a deletion, mutation, and/or substitution in an endogenous polynucleotide or gene encoding a polypeptide having PDC activity, or in an endogenous polypeptides having PDC activity. Such modifications, disruptions, deletions, mutations, and/or substitutions can result in PDC activity that is reduced or eliminated, resulting, for example, in a PDC knock-out (PDC-KO) phenotype.

In embodiments of the invention, an endogenous pyruvate decarboxylase activity of a recombinant host cell disclosed herein converts pyruvate to acetaldehyde, which can then be converted to ethanol or to acetyl-CoA via acetate. In other embodiments, a recombinant host cell is *Kluyveromyces lactis* containing one gene encoding pyruvate decarboxylase, *Candida glabrata* containing one gene encoding pyruvate decarboxylase, or *Schizosaccharomyces pombe* containing one gene encoding pyruvate decarboxylase.

In other embodiments, a recombinant host cell is *Saccharomyces cerevisiae* containing three isozymes of pyruvate decarboxylase encoded by the PDC1, PDC5, and PDC6 genes, as well as a pyruvate decarboxylase regulatory gene, PDC2. In a non-limiting example in *S. cerevisiae*, the PDC1 and PDC5 genes, or the PDC1, PDC5, and PDC6 genes, are disrupted. In another non-limiting example in *S. cerevisiae*, pyruvate decarboxylase activity can be reduced by disrupting the PDC2 regulatory gene. In another non-limiting example in *S. cerevisiae*, polynucleotides or genes encoding pyruvate decarboxylase proteins such as those having about 70% to about 75%, about 75% to about 80%, about 80% to about 85%, about 85% to about 90%, about 90% to about 95%, about 96%, about 97%, about 98%, or about 99% sequence identity to PDC1, PDC2, PDC5 and/or PDC6 can be disrupted.

In embodiments, a polypeptide having PDC activity or a polynucleotide or gene encoding a polypeptide having PDC activity corresponds to Enzyme Commission Number EC 4.1.1.1. In other embodiments, a PDC gene of a recombinant host cell disclosed herein is not active under the fermentation conditions used, and therefore such a gene would not need to be modified or inactivated.

Examples of recombinant host cells with reduced pyruvate decarboxylase activity due to disruption of pyruvate decarboxylase encoding genes have been reported, such as for *Saccharomyces* in Flikweert et al. (*Yeast* (1996) 12:247-257), for *Kluyveromyces* in Bianchi et al. (*Mol. Microbiol.* (1996) 19(1):27-36), and disruption of the regulatory gene in Hohmann (*Mol. Gen. Genet.* (1993) 241:657-666). *Saccharomyces* strains having no pyruvate decarboxylase activity are available from the ATCC with Accession #200027 and #200028. Examples of PDC polynucleotides, genes and/or polypeptides that can be targeted for modification or inactivation in the recombinant host cells disclosed herein include, but are not limited to, those of the following Table 8.

TABLE 8

Pyruvate decarboxylase target gene coding regions and proteins.

| Description | SEQ ID NO: Nucleic acid | SEQ ID NO: Amino acid |
| --- | --- | --- |
| PDC1 pyruvate decarboxylase from *Saccharomyces cerevisiae* | 648 | 649 |
| PDC5 pyruvate decarboxylase from *Saccharomyces cerevisiae* | 650 | 651 |
| PDC6 pyruvate decarboxylase from *Saccharomyces cerevisiae* | 652 | 653 |
| pyruvate decarboxylase from *Candida glabrata* | 654 | 655 |
| PDC1 pyruvate decarboxylase from *Pichia stipitis* | 656 | 657 |
| PDC2 pyruvate decarboxylase from *Pichia stipitis* | 658 | 659 |
| pyruvate decarboxylase from *Kluyveromyces lactis* | 660 | 661 |
| pyruvate decarboxylase from *Yarrowia lipolytica* | 662 | 663 |
| pyruvate decarboxylase from *Schizosaccharomyces pombe* | 664 | 665 |
| pyruvate decarboxylase from *Zygosaccharomyces rouxii* | 666 | 667 |

Other examples of PDC polynucleotides, genes and polypeptides that can be targeted for modification or inactivation in a recombinant host cell disclosed herein include, but are not limited to, PDC polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 8, wherein such a polynucleotide or gene encodes, or such a polypeptide has, PDC activity. Still other examples of PDC polynucleotides, genes and polypeptides that can be targeted for modification or inactivation in a recombinant host cell disclosed herein include, but are not limited to an active variant, fragment or derivative of any one of the sequences of Table 8, wherein such a polynucleotide or gene encodes, or such a polypeptide has, PDC activity.

In embodiments, a polynucleotide, gene and/or polypeptide encoding a PDC sequence disclosed herein or known in the art can be modified, as disclosed above for aldehyde dehydrogenase. In other embodiments, a polynucleotide, gene and/or polypeptide encoding PDC can be used to identify another PDC polynucleotide, gene and/or polypeptide sequence or to identify a PDC homolog in other cells, as disclosed above for acetolactate dehydrogenase. Such a PDC encoding sequence can be identified, for example, in the literature and/or in bioinformatics databases well known to the skilled person. For example, the identification of a PDC encoding sequence in other cell types using bioinformatics can be accomplished through BLAST (as described above) searching of publicly available databases with a known PDC encoding DNA and polypeptide sequence, such as those provided herein. Identities are based on the Clustal W method of alignment using the default parameters of GAP PENALTY=10, GAP LENGTH PENALTY=0.1, and Gonnet 250 series of protein weight matrix.

The modification of PDC in a recombinant host cell disclosed herein to reduce or eliminate PDC activity can be confirmed using methods known in the art. For example, disruption of a particular pyruvate decarboxylase could be confirmed with PCR screening using primers external to the gene sequence, or by Southern blot using a probe designed to the pyruvate decarboxylase gene sequence. Alternatively, one could utilize analytical methods such as gas chromatography or HPLC to screen strains for decreased or eliminated production of acetaldehyde and/or ethanol.

Functional deletion of the hexokinase 2 gene has been used to reduce glucose repression and to increase the availability of pyruvate for utilization in biosynthetic pathways. For example, International Publication No. WO 2000/061722 A1, which is incorporated herein by reference in its entirety discloses the production of yeast biomass by aerobically growing yeast having one or more functionally deleted hexokinase 2 genes or analogs. In addition, Rossell et al. (Yeast Research 8:155-164 (2008)) found that *Saccharomyces cerevisiae* with a deletion of the hexokinase 2 gene showed 75% reduction in fermentative capacity, defined as the specific rate of carbon dioxide production under sugar-excess and anaerobic conditions. After starvation, the fermentation capacity was similar to that of a strain without the hexokinase 2 gene deletion. Diderich et al. (Applied and Environmental Microbiology 67:1587-1593 (2001)) found that *S. cerevisiae* with a deletion of the hexokinase 2 gene had lower pyruvate decarboxylase activity.

In embodiments, a recombinant host cell disclosed herein can comprise a modification in an endogenous polynucleotide encoding a polypeptide having hexokinase 2 activity and/or a modification in a polypeptide having hexokinase 2 activity. In embodiments, a recombinant host cell disclosed herein can have a modification or disruption of a polynucleotide, gene or polypeptide encoding hexokinase 2. In embodiments, a recombinant host cell comprises a deletion, mutation, and/or substitution in an endogenous polynucleotide or gene encoding a polypeptide having hexokinase 2 activity, or an endogenous polypeptide having hexokinase 2 activity. Such modifications, disruptions, deletions, mutations, and/or substitutions can result in hexokinase 2 activity that is reduced or eliminated, resulting, for example, in a hexokinase 2 knockout (HXK2-KO) phenotype. In embodiments, the host cell comprises a modification as described in U.S. Appn.

Serial. Nos. 2011/0124060 A1 or 2012/0015416 A1, which are incorporated herein by reference in their entireties.

In embodiments, a polypeptide having hexokinase 2 activity can catalyze the conversion of hexose to hexose-6-phosphate, and/or can catalyze the conversion of D-glucose to D-glucose 6-phosphate, D-fructose to D-fructose 6-phosphate, and/or D-mannose to D-mannose 6-phosphate. In other embodiments, a polynucleotide, gene or polypeptide having hexokinase 2 activity can correspond to Enzyme Commission Number EC 2.7.1.1.

In embodiments of the invention, a recombinant host cell can be *S. cerevisiae* and a polynucleotide, gene or polypeptide having hexokinase 2 activity can be HXK2. In other embodiments, a recombinant host cell can be *K. lactis* and a polynucleotide, gene or polypeptide having hexokinase 2 activity can be RAG5. In other embodiments, a recombinant host cell can be *H. polymorpha* and a polynucleotide, gene or polypeptide having hexokinase 2 activity can be HPGLK1. In other embodiments, a recombinant host cell can be *S. pombe* and a polynucleotide, gene or polypeptide having hexokinase 2 activity can be HXK2.

Examples of hexokinase 2 polynucleotides, genes and polypeptides that can be targeted for modification or inactivation in a recombinant host cell disclosed herein include, but are not limited to, those of the following Table 9.

TABLE 9

Hexokinase 2 target gene coding regions and proteins.

| | |
|---|---|
| HXK2 from S. cerevisiae | Nucleic acid (SEQ ID NO: 668) Amino acid (SEQ ID NO: 669) |
| RAG5 from K. lactis | Nucleic acid (SEQ ID NO: 670): Amino acid (SEQ ID NO: 671) |
| HPGLK1 from H. polymorpha | Nucleic acid (SEQ ID NO: 672) Amino acid (SEQ ID NO: 673) |
| HXK2 from S. pombe | Nucleic acid (SEQ ID NO: 674): Amino acid (SEQ ID NO: 675): |

Other examples of hexokinase 2 polynucleotides, genes and polypeptides that can be targeted for modification or inactivation in a recombinant host cell disclosed herein include, but are not limited to, hexokinase 2 polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 9, wherein such a polynucleotide or gene encodes, or such a polypeptide has, hexokinase 2 activity. Still other examples of hexokinase 2 polynucleotides, genes and polypeptides that can be targeted for modification or inactivation in a recombinant host cell disclosed herein include, but are not limited to an active variant, fragment or derivative of any one of the sequences of Table 9, wherein such a polynucleotide or gene encodes, or such a polypeptide has, hexokinase 2 activity.

In embodiments, a polynucleotide, gene and/or polypeptide encoding a hexokinase 2 sequence disclosed herein or known in the art can be modified or disrupted, as disclosed above for aldehyde dehydrogenase. In other embodiments, a polynucleotide, gene and/or polypeptide encoding hexokinase 2 can be used to identify another hexokinase 2 polynucleotide, gene and/or polypeptide sequence or to identify a hexokinase 2 homolog in other cells, as disclosed above for aldehyde dehydrogenase. Such a hexokinase 2 encoding sequence can be identified, for example, in the literature and/or in bioinformatics databases well known to the skilled person. For example, the identification of a hexokinase 2 encoding sequence in other cell types using bioinformatics can be accomplished through BLAST (as described above) searching of publicly available databases with a known hexokinase 2 encoding DNA and polypeptide sequence, such as those provided herein. Identities are based on the Clustal W method of alignment using the default parameters of GAP PENALTY=10, GAP LENGTH PENALTY=0.1, and Gonnet 250 series of protein weight matrix.

The modification of hexokinase 2 in a recombinant host cell disclosed herein to reduce or eliminate hexokinase 2 activity can be confirmed using methods known in the art. For example, disruption of hexokinase 2 could be confirmed with PCR screening using primers external to the hexokinase 2 gene, or by Southern blot using a probe designed to the hexokinase 2 gene sequence. Alternatively, one could examine putative hexokinase 2 knockout strains for increased biomass yield on glucose-containing media.

Examples of additional modifications that can be useful in cells provided herein include modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 2009/0305363 (incorporated herein by reference), modifications to a host cell that provide for increased carbon flux through an Entner-Doudoroff Pathway or reducing equivalents balance as described in U.S. Patent Appl. Pub. No. 2010/0120105 (incorporated herein by reference). Other modifications include integration of at least one polynucleotide encoding a polypeptide that catalyzes a step in a pyruvate-utilizing biosynthetic pathway described in PCT Appn. Pub. No. WO 2012/033832, which is herein incorporated by reference in its entirety. A genetic modification which has the effect of reducing glucose repression wherein the yeast production host cell is pdc— is described in U.S. Appl. Publ No. US 2011/0124060, which is herein incorporated by reference in its entirety.

U.S. Appl. Publ. No. 20120064561A1, which is herein incorporated by reference, discloses recombinant host cells comprising (a) at least one heterologous polynucleotide encoding a polypeptide having dihydroxy-acid dehydratase activity; and (b)(i) at least one deletion, mutation, and/or substitution in an endogenous gene encoding a polypeptide affecting Fe—S duster biosynthesis; and/or (ii) at least one heterologous polynucleotide encoding a polypeptide affecting Fe—S duster biosynthesis. In embodiments, the polypeptide affecting Fe—S duster biosynthesis is encoded by AFT1, AFT2, FRA2, GRX3, or CCC1. In embodiments, the polypeptide affecting Fe—S duster biosynthesis is constitutive mutant AFT1 L99A, AFT1 L102A, AFT1 C291F, or AFT1 C293F.

Additionally, host cells can comprise heterologous polynucleotides encoding a polypeptides with phosphoketolase activity and/or a heterologous polynucleotide encoding a polypeptide with phosphotransacetylase activity such as, for example, those encoded by SEQ ID NOs: 962 and 963, and as described in PCT Appn. Pub. No. WO 2011/159853, which is herein incorporated by reference in its entirety.

Isobutanol and Other Products

In embodiments of the invention, methods for the production of a product of a biosynthetic pathway are provided which comprise (a) providing a recombinant host cell disclosed herein; and (b) growing the host cell under conditions whereby the product of the biosynthetic pathway is produced. In other embodiments, the product is produced as a co-product along with ethanol. In still other embodiments, the product of the biosynthetic pathway is isobutanol.

In other embodiments of the invention, the product of the biosynthetic pathway is produced at a greater yield or amount compared to the production of the same product in a recombinant host cell that does not comprise reduced or eliminated aldehyde dehydrogenase and/or aldehyde oxidase activity and/or acetolactate reductase activity. In embodiments, yield is increased by at least about 2%, at least about 5% or at least about 10%. In embodiments, this greater yield includes production at a yield of greater than about 10% of theoretical, at a yield of greater than about 20% of theoretical, at a yield of greater than about 25% of theoretical, at a yield of greater than about 30% of theoretical, at a yield of greater than about 40% of theoretical, at a yield of greater than about 50% of theoretical, at a yield of greater than about 60% of theoretical, at a yield of greater than about 70% of theoretical, at a yield of greater than about 75% of theoretical, at a yield of greater than about 80% of theoretical at a yield of greater than about 85% of theoretical, at a yield of greater than about 90% of theoretical, at a yield of greater than about 95% of theoretical, at a yield of greater than about 96% of theoretical, at a yield of greater than about 97% of theoretical, at a yield of greater than about 98% of theoretical, at a yield of greater than about 99% of theoretical, or at a yield of about 100% of theoretical. In other embodiments, the product is produced as a co-product along with ethanol. In still other embodiments, the product of the biosynthetic pathway is isobutanol.

Any product of a biosynthetic pathway that has the conversion of isobutyraldehyde to isobutyric acid as a pathway by-product can be produced with greater effectiveness in a recombinant host cell disclosed herein having the described modification of aldehyde dehydrogenase and/or aldehyde oxidase activity. A list of such products includes, but is not limited to, isobutanol.

Microbial Hosts for Isobutanol Production

Microbial hosts for isobutanol production can be selected from bacteria, cyanobacteria, filamentous fungi and yeasts. The microbial host used for butanol production should be tolerant to isobutanol so that the yield is not limited by butanol toxicity. Although butanol-tolerant mutants have been isolated from solventogenic Clostridia, little information is available concerning the butanol tolerance of other potentially useful bacterial strains. Most of the studies on the comparison of alcohol tolerance in bacteria suggest that butanol is more toxic than ethanol (de Cavalho, et al., Microsc. Res. Tech., 64: 215-22, 2004) and (Kabelitz, et al., FEMS Microbiol. Lett., 220: 223-227, 2003, Tomas, et al., J. Bacteriol., 186: 2006-2018, 2004) report that the yield of 1-butanol during fermentation in Clostridium acetobutylicum can be limited by 1-butanol toxicity. The primary effect of 1-butanol on Clostridium acetobutylicum is disruption of membrane functions (Hermann et al., Appl. Environ. Microbiol., 50: 1238-1243, 1985).

The microbial hosts selected for the production of isobutanol should be tolerant to isobutanol and should be able to convert carbohydrates to isobutanol. The criteria for selection of suitable microbial hosts include the following: intrinsic tolerance to isobutanol, high rate of glucose utilization, availability of genetic tools for gene manipulation, and the ability to generate stable chromosomal alterations.

Suitable host strains with a tolerance for isobutanol can be identified by screening based on the intrinsic tolerance of the strain. The intrinsic tolerance of microbes to isobutanol can be measured by determining the concentration of isobutanol that is responsible for 50% inhibition of the growth rate ($IC_{50}$) when grown in a minimal medium. The $IC_{50}$ values can be determined using methods known in the art. For example, the microbes of interest can be grown in the presence of various amounts of isobutanol and the growth rate monitored by measuring the optical density at 600 nanometers. The doubling time can be calculated from the logarithmic part of the growth curve and used as a measure of the growth rate. The concentration of isobutanol that produces 50% inhibition of growth can be determined from a graph of the percent inhibition of growth versus the isobutanol concentration. In one embodiment, the host strain has an $IC_{50}$ for isobutanol of greater than about 0.5%.

The microbial host for isobutanol production should also utilize glucose at a high rate. Most microbes are capable of metabolizing carbohydrates. However, certain environmental microbes cannot metabolize carbohydrates to high efficiency, and therefore would not be suitable hosts.

The ability to genetically modify the host is essential for the production of any recombinant microorganism. The mode of gene transfer technology can be by electroporation, conjugation, transduction or natural transformation. A broad range of host conjugative plasmids and drug resistance markers are available. The cloning vectors are tailored to the host microorganisms based on the nature of antibiotic resistance markers that can function in that host.

The microbial host also has to be manipulated in order to inactivate competing pathways for carbon flow by deleting various genes. This requires the availability of either transposons to direct inactivation or chromosomal integration vectors. Additionally, the production host should be amenable to chemical mutagenesis so that mutations to improve intrinsic isobutanol tolerance can be obtained.

Based on the criteria described above, suitable microbial hosts for the production of isobutanol include, but are not limited to, members of the genera Clostridium, Zymomonas, Escherichia, Salmonella, Rhodococcus, Pseudomonas, Bacillus, Vibrio, Lactobacillus, Enterococcus, Alcaligenes, Klebsiella, Paenibacillus, Arthrobacter, Corynebacterium, Brevibacterium, Pichia, Candida, Issatchenkia, Hansenula, Kluyveromyces, and Saccharomyces. Suitable hosts include: Escherichia coli, Alcaligenes eutrophus, Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis and Saccharomyces cerevisiae. In some embodiments, the host cell is Saccharomyces cerevisiae. S. cerevisiae yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. S. cerevisiae include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Construction of Production Host

Recombinant microorganisms containing the necessary genes that will encode the enzymatic pathway for the conversion of a fermentable carbon substrate to butanol can be constructed using techniques well known in the art. In the present invention, genes encoding the enzymes of one of the isobutanol biosynthetic pathways of the invention, for example, acetolactate synthase, acetohydroxy acid isomeroreductase, acetohydroxy acid dehydratase, branched-chain α-keto acid decarboxylase, and branched-chain alcohol dehydrogenase, can be isolated from various sources, as described above.

Methods of obtaining desired genes from a genome are common and well known in the art of molecular biology. For example, if the sequence of the gene is known, suitable genomic libraries can be created by restriction endonuclease digestion and can be screened with probes complementary to the desired gene sequence. Once the sequence is isolated, the DNA can be amplified using standard primer-directed amplification methods such as polymerase chain reaction (U.S. Pat. No. 4,683,202) to obtain amounts of DNA suitable for transformation using appropriate vectors. Tools for codon optimization for expression in a heterologous host are readily available. Some tools for codon optimization are available based on the GC content of the host microorganism.

Once the relevant pathway genes are identified and isolated they can be transformed into suitable expression hosts by means well known in the art. Vectors or cassettes useful for the transformation of a variety of host cells are common and commercially available from companies such as EPICENTRE® (Madison, Wis.), Invitrogen Corp. (Carlsbad, Calif.), Stratagene (La Jolla, Calif.), and New England Biolabs, Inc. (Beverly, Mass.). Typically the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. Both control regions can be derived from genes homologous to the transformed host cell, although it is to be understood that such control regions can also be derived from genes that are not native to the specific species chosen as a production host.

Initiation control regions or promoters, which are useful to drive expression of the relevant pathway coding regions in the desired host cell are numerous and familiar to those skilled in the art. Virtually any promoter capable of driving these genetic elements, including those used in the Examples, is suitable for the present invention including, but not limited to, CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, ara, tet, trp, $IP_L$, $IP_R$, T7, tac, and trc (useful for expression in *Escherichia coli, Alcaligenes,* and *Pseudomonas*) as well as the amy, apr, npr promoters and various phage promoters useful for expression in *Bacillus subtilis, Bacillus licheniformis,* and *Paenibacillus macerans*. For yeast recombinant host cells, a number of promoters can be used in constructing expression cassettes for genes, including, but not limited to, the following constitutive promoters suitable for use in yeast: FBA1, TDH3 (GPD), ADH1, ILV5, and GPM1; and the following inducible promoters suitable for use in yeast: GAL1, GAL10, OLE1, and CUP1. Other yeast promoters include hybrid promoters UAS(PGK1)-FBA1p (SEQ ID NO: 406), UAS(PGK1)-ENO2p (SEQ ID NO: 538), UAS(FBA1)-PDC1p (SEQ ID NO: 539), UAS (PGK1)-PDC1p (SEQ ID NO: 540), and UAS(PGK)-OLE1p (SEQ ID NO: 541).

Promoters, transcriptional terminators, and coding regions can be cloned into a yeast 2 micron plasmid and transformed into yeast cells (Ludwig, et al, Gene, 132: 33-40, 1993; US Appl. Pub. No, 20080261861 A1).

Adjusting the amount of gene expression in a given host may be achieved by varying the level of transcription, such as through selection of native or artificial promoters. In addition, techniques such as the use of promoter libraries to achieve desired levels of gene transcription are well known in the art. Such libraries can be generated using techniques known in the art, for example, by cloning of random cDNA fragments in front of gene cassettes (Goh et al, (2002) *AEM* 99, 17025), by modulating regulatory sequences present within promoters (Ligr et al. (2006) *Genetics* 172, 2113), or by mutagenesis of known promoter sequences (Alper et al. (2005) *PNAS,* 12678; Nevoigt et al, (2006) *AEM* 72, 5266).

Termination control regions can also be derived from various genes native to the hosts. Optionally, a termination site can be unnecessary or can be included.

Certain vectors are capable of replicating in a broad range of host bacteria and can be transferred by conjugation. The complete and annotated sequence of pRK404 and three related vectors-pRK437, pRK442, and pRK442(H) are available. These derivatives have proven to be valuable tools for genetic manipulation in Gram-negative bacteria (Scott et al., Plasmid, 50: 74-79, 2003), Several plasmid derivatives of broad-host-range Inc P4 plasmid RSF1010 are also available with promoters that can function in a range of Gram-negative bacteria. Plasmid pAYC36 and pAYC37, have active promoters along with multiple cloning sites to allow for the heterologous gene expression in Gram-negative bacteria.

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., *J. Bacteriol.,* 174: 5633-5638, 1992). Additionally, in vitro transposomes are available to create random mutations in a variety of genomes from commercial sources such as EPICENTRE®.

The expression of a butanol biosynthetic pathway in various microbial hosts is described in more detail below.

Expression of a Butanol Biosynthetic Pathway in *E. Coli*

Vectors or cassettes useful for the transformation of *E. coli* are common and commercially available from the companies listed above. For example, the genes of an isobutanol biosynthetic pathway can be isolated from various sources, cloned into a modified pUC19 vector and transformed into *E. coli/* NM522.

Expression of a Butanol Biosynthetic Pathway in *Rhodococcus erythropolis*

A series of *E. coli-Rhodococcus* shuttle vectors are available for expression in *R. erythropolis*, including, but not limited to, pRhBR17 and pDA71 (Kostichka et al., Appl. Microbiol. Biotechnol., 62: 61-68, 2003). Additionally, a series of promoters are available for heterologous gene expression in *R. erythropolis* (Nakashima et al., Appl. Environ. Microbiol., 70: 5557-5568, 2004 and Tao et al., Appl. Microbiol. Biotechnol., 68: 346-354, 2005). Targeted gene disruption of chromosomal genes in *R. erythropolis* can be created using the method described by Tao et al., supra, and Brans et al. (Appl. Environ. Microbiol., 66: 2029-2036, 2000).

The heterologous genes required for the production of isobutanol, as described above, can be cloned initially in pDA71 or pRhBR71 and transformed into *E. coli*. The vectors can then be transformed into *R. erythropolis* by electroporation, as described by Kostichka et al., supra. The recombinants can be grown in synthetic medium containing glucose and the production of isobutanol can be followed using methods known in the art.

Expression of a Butanol Biosynthetic Pathway in *B. Subtilis*

Methods for gene expression and creation of mutations in *B. subtilis* are also well known in the art. For example, the genes of an isobutanol biosynthetic pathway can be isolated from various sources, cloned into a modified pUC19 vector and transformed into *Bacillus subtilis* BE1010. Additionally, the five genes of an isobutanol biosynthetic pathway can be split into two operons for expression. The three genes of the pathway (bubB, ilvD, and kivD) can be integrated into the chromosome of *Bacillus subtilis* BE1010 (Payne, et al., J. Bacteriol., 173, 2278-2282, 1991). The remaining two genes (ilvC and bdhB) can be cloned into an expression vector and transformed into the *Bacillus* strain carrying the integrated isobutanol genes Expression of a Butanol Biosynthetic Pathway in *B. Licheniformis*

Most of the plasmids and shuttle vectors that replicate in *B. subtilis* can be used to transform *B. licheniformis* by either protoplast transformation or electroporation. The genes required for the production of isobutanol can be cloned in plasmids pBE20 or pBE60 derivatives (Nagarajan et al., Gene, 114: 121-126, 1992). Methods to transform *B. licheniformis* are known in the art (Fleming et al, Appl. Environ. Microbiol., 61: 3775-3780, 1995). The plasmids constructed for expression in *B. subtilis* can be transformed into *B. licheniformis* to produce a recombinant microbial host that produces isobutanol.

Expression of a Butanol Biosynthetic Pathway in *Paenibacillus macerans*

Plasmids can be constructed as described above for expression in *B. subtilis* and used to transform *Paenibacillus macerans* by protoplast transformation to produce a recombinant microbial host that produces isobutanol.

Expression of the Butanol Biosynthetic Pathway in *Alcaligenes* (Ralstonia) *eutrophus*

Methods for gene expression and creation of mutations in *Alcaligenes eutrophus* are known in the art (Taghavi et al., Appl. Environ. Microbiol., 60: 3585-3591, 1994). The genes for an isobutanol biosynthetic pathway can be cloned in any of the broad host range vectors described above, and electroporated to generate recombinants that produce isobutanol. The poly(hydroxybutyrate) pathway in *Alcaligenes* has been described in detail, a variety of genetic techniques to modify the *Alcaligenes eutrophus* genome is known, and those tools can be applied for engineering an isobutanol biosynthetic pathway.

Expression of a Butanol Biosynthetic Pathway in *Pseudomonas putida*

Methods for gene expression in *Pseudomonas putida* are known in the art (see for example Ben-Basset et al., U.S. Pat. No. 6,586,229, which is incorporated herein by reference). The butanol pathway genes can be inserted into pPCU18 and this ligated DNA can be electroporated into electrocompetent *Pseudomonas putida* DOT-T1 C5aAR1 cells to generate recombinants that produce isobutanol.

Expression of a Butanol Biosynthetic Pathway in *Saccharomyces cerevisiae*

Methods for gene expression in *Saccharomyces cerevisiae* are known in the art (e.g., *Methods in Enzymology*, Volume 194, *Guide to Yeast Genetics and Molecular and Cell Biology*, Part A, 2004, Christine Guthrie and Gerald R. Fink, eds., Elsevier Academic Press, San Diego, Calif.). Expression of genes in yeast typically requires a promoter, followed by the gene of interest, and a transcriptional terminator. A number of yeast promoters, including those used in the Examples herein, can be used in constructing expression cassettes for genes encoding an isobutanol biosynthetic pathway, including, but not limited to constitutive promoters FBA, GPD, ADH1, and GPM, and the inducible promoters GAL1, GAL10, and CUP1. Suitable transcriptional terminators include, but are not limited to FBAt, GPDt, GPMt, ERG10t, GAL1t, CYC1, and ADH1. For example, suitable promoters, transcriptional terminators, and the genes of an isobutanol biosynthetic pathway can be cloned into *E. coli*-yeast shuttle vectors and transformed into yeast cells as described in U.S. App. Pub. No. 20100129886. These vectors allow strain propagation in both *E. coli* and yeast strains. Typically the vector contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2 μl origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with genes encoding polypeptides of interest can be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a ≥21 bp sequence at both the 5' and the 3' ends that sequentially overlap with each other, and with the 5' and 3' terminus of the vector DNA. For example, to construct a yeast expression vector for "Gene X", a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Expression of a Butanol Biosynthetic Pathway in *Lactobacillus plantarum*

The *Lactobacillus* genus belongs to the Lactobacillales family and many plasmids and vectors used in the transformation of *Bacillus subtilis* and *Streptococcus* can be used for *Lactobacillus*. Non-limiting examples of suitable vectors include pAMβ1 and derivatives thereof (Renault et al., Gene 183:175-182, 1996); and (O'Sullivan et al., Gene, 137: 227-231, 1993); pMBB1 and pHW800, a derivative of pMBB1 (Wyckoff et al., Appl. Environ. Microbiol., 62: 1481-1486, 1996); pMG1, a conjugative plasmid (Tanimoto et al., J. Bacteriol., 184: 5800-5804, 2002); pNZ9520 (Kleerebezem et al., Appl. Environ. Microbiol., 63: 4581-4584, 1997); pAM401 (Fujimoto et al., Appl. Environ. Microbiol., 67: 1262-1267, 2001); and pAT392 (Arthur et al., Antimicrob. Agents Chemother., 38: 1899-1903, 1994). Several plasmids from *Lactobacillus plantarum* have also been reported (van Kranenburg R, et al. Appl. Environ. Microbiol., 71: 1223-1230, 2005).

Expression of a Butanol Biosynthetic Pathway in Various *Enterococcus* species (*E. faecium, E. gallinarium*, and *E. faecalis*)

The *Enterococcus* genus belongs to the Lactobacillales family and many plasmids and vectors used in the transformation of Lactobacilli, Bacilli and Streptococci species can be used for *Enterococcus* species. Non-limiting examples of suitable vectors include pAMβ1 and derivatives thereof (Renault et al., Gene, 183: 175-182, 1996); and (O'Sullivan et al., Gene, 137: 227-231, 1993); pMBB1 and pHW800, a derivative of pMBB1 (Wyckoff et al. Appl. Environ. Microbiol., 62: 1481-1486, 1996); pMG1, a conjugative plasmid (Tanimoto et al., J. Bacteriol., 184: 5800-5804, 2002); pNZ9520 (Kleerebezem et al., Appl. Environ. Microbiol., 63: 4581-4584, 1997); pAM401 (Fujimoto et al., Appl. Environ. Microbiol., 67: 1262-1267, 2001); and pAT392 (Arthur et al., Antimicrob. Agents Chemother., 38: 1899-1903, 1994). Expression vectors for *E. faecalis* using the nisA gene from *Lactococcus* can also be used (Eichenbaum et al., Appl. Environ. Microbiol., 64: 2763-2769, 1998). Additionally, vectors for gene replacement in the *E. faecium* chromosome can be used (Nallapareddy et al., Appl. Environ. Microbiol., 72: 334-345, 2006).

Fermentation Media

Fermentation media in the present invention must contain suitable carbon substrates. Suitable substrates can include but are not limited to monosaccharides such as glucose and fructose, oligosaccharides such as lactose, maltose, galactose, sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate can also be one-carbon substrates such as carbon dioxide, or methanol for which metabolic conversion into key biochemical intermediates has been demonstrated. In addition to one and two carbon substrates methylotrophic microorganisms are also known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., *Microb. Growth C1 Compd.*, [Int. Symp.], 7th (1993), 415-32. (eds): Murrell, J. Collin; Kelly, Don P. Publisher; Intercept, Andover, UK). Similarly, various species of *Candida* will metabolize alanine or oleic acid (Sulter et al., Arch. Microbiol., 153: 485-489, 1990). Hence it is contemplated that the source of carbon utilized in the present invention can encompass a wide variety of carbon containing substrates and will only be limited by the choice of microorganism.

Although it is contemplated that all of the above mentioned carbon substrates and mixtures thereof are suitable in the present invention, in some embodiments, the carbon substrates are glucose, fructose, and sucrose, or mixtures of these with C5 sugars such as xylose and/or arabinose for yeasts cells modified to use C5 sugars. Sucrose can be derived from renewable sugar sources such as sugar cane, sugar beets, cassava, sweet sorghum, and mixtures thereof. Glucose and dextrose can be derived from renewable grain sources through saccharification of starch based feedstocks including grains such as corn, wheat, rye, barley, oats, and mixtures thereof. In addition, fermentable sugars can be derived from renewable cellulosic or lignocellulosic biomass through processes of pretreatment and saccharification, as described, for example, in U.S. Parent App. Pub. No. 2007/0031918 A1, which is herein incorporated by reference in its entirety. Biomass refers to any cellulosic or lignocellulosic material and includes materials comprising cellulose, and optionally further comprising hemicellulose, lignin, starch, oligosaccharides and/or monosaccharides. Biomass can also comprise additional components, such as protein and/or lipid. Biomass can be derived from a single source, or biomass can comprise a mixture derived from more than one source; for example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In addition to an appropriate carbon source, fermentation media must contain suitable minerals, salts, cofactors, buffers and other components, known to those skilled in the art, suitable for growth of the cultures and promotion of the enzymatic pathway necessary for butanol production described herein.

Culture Conditions

Typically cells are grown at a temperature in the range of about 20° C. to about 40° C. in an appropriate medium. Suitable growth media in the present invention are common commercially prepared media such as Luria Bertani (LB) broth, Sabouraud Dextrose (SD) broth or Yeast Medium (YM) broth or broth that includes yeast nitrogen base, ammonium sulfate, and dextrose (as the carbon/energy source) or YPD Medium, a blend of peptone, yeast extract, and dextrose in optimal proportions for growing most *Saccharomyces cerevisiae* strains. Other defined or synthetic growth media can also be used, and the appropriate medium for growth of the particular microorganism will be known by one skilled in the art of microbiology or fermentation science. The use of agents known to modulate catabolite repression directly or indirectly, e.g., cyclic adenosine 2',3'-monophosphate (CAMP), can also be incorporated into the fermentation medium.

Suitable pH ranges for the fermentation are between pH 5.0 to pH 9.0, where pH 6.0 to pH 8.0 is preferred for the initial condition. Suitable pH ranges for the fermentation of yeast are typically between about pH 3.0 to about pH 9.0. In one embodiment, about pH 5.0 to about pH 8.0 is used for the initial condition. Suitable pH ranges for the fermentation of other microorganisms are between about pH 3.0 to about pH 7.5. In one embodiment, about pH 4.5 to about pH 6.5 is used for the initial condition.

Fermentations can be performed under aerobic or anaerobic conditions. In one embodiment, anaerobic or microaerobic conditions are used for fermentation.

Industrial Batch and Continuous Fermentations

The present processes may employ a batch method of fermentation. A classical batch fermentation is a dosed system where the composition of the medium is set at the beginning of the fermentation and not subject to artificial alterations during the fermentation. Thus, at the beginning of the fermentation the medium is inoculated with the desired microorganism or microorganisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the medium. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples can be found in Thomas D. Brock in *Biotechnology: A Textbook of Industrial Microbiology*, Second Edition (1989) Sinauer Associates, Inc., Sunderland, Mass., or Deshpande, Mukund (Appl. Biochem. Biotechnol., 36: 227, 1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned medium is removed simultaneously for processing. Continuous fermentation generally maintains the cultures at a constant high density where cells are primarily in log phase growth.

Continuous fermentation allows for modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by medium turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention can be practiced using either batch, fed-batch or continuous processes and that any known mode of fermentation would be suitable. Additionally, it is contemplated that cells can be immobilized on a substrate as whole cell catalysts and subjected to fermentation conditions for isobutanol production.

Methods for Butanol Isolation from the Fermentation Medium

Bioproduced butanol can be isolated from the fermentation medium using methods known in the art for ABE fermentations (see, e.g., Durre, *Appl. Microbiol. Biotechnol.* 49:639-648 (1998), Groot et al., *Process. Biochem.* 27:61-75 (1992), and references therein). For example, solids can be removed from the fermentation medium by centrifugation, filtration, decantation, or the like. Then, the butanol can be isolated from the fermentation medium using methods such as distillation, azeotropic distillation, liquid-liquid extraction, adsorption, gas stripping, membrane evaporation, or pervaporation.

Because butanol forms a low boning point, azeotropic mixture with water, distillation can be used to separate the mixture up to its azeotropic composition. Distillation can be used in combination with another separation method to obtain separation around the azeotrope. Methods that can be used in combination with distillation to isolate and purify butanol include, but are not limited to, decantation, liquid-liquid extraction, adsorption, and membrane-based techniques. Additionally, butanol can be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation can be used in combination with decantation to isolate and purify the butanol. In this method, the butanol containing fermentation broth is distilled to near the azeotropic composition. Then, the azeotropic mixture is condensed, and the butanol is separated from the fermentation medium by decantation. The decanted aqueous phase can be returned to the first distillation column as reflux. The butanol-rich decanted organic phase can be further purified by distillation in a second distillation column.

The butanol can also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption can also be used to isolate butanol from the fermentation medium. In this method, the fermentation broth containing the butanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation can be used to isolate and purify the butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, the ester can be formed by contacting the alcohol in a fermentation medium with a carboxylic acid (e.g., fatty acids) and a catalyst capable of esterifying the alcohol with the carboxylic acid, as described in PCT Appn. Pub. No, WO/2011/159998, which is herein incorporated by reference in its entirety. In such embodiments, the carboxylic acid can serve as an ISPR extractant into which the alcohol esters partition. The carboxylic acid can be supplied to the fermentation vessel and/or derived from the biomass supplying fermentable carbon fed to the fermentation vessel. Lipids present in the feedstock can be catalytically hydrolyzed to carboxylic acid, and the same catalyst (e.g., enzymes) can esterify the carboxylic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into carboxylic acid and substantially simultaneous esterification of the carboxylic acid with butanol present in the fermentation vessel. Carboxylic acid and/or native oil not derived from the feedstock can also be fed to the fermentation vessel, with the native oil being hydrolyzed into carboxylic acid. Any carboxylic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester may reduce the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to carboxylic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the carboxylic acid extractant can contact the fermentation medium at a time before the butanol concentration reaches a toxic level, so as to esterify the butanol with the carboxylic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods:

Standard recombinant DNA and molecular cloning techniques used in the Examples are well known in the art and are described by Sambrook, J., Fritsch, E. F. and Maniatis, T., Molecular Cloning: A Laboratory Manual, Cold Spring Harbor Laboratory Press, Cold Spring Harbor, N.Y., 1989, by T. J. Silhavy, M. L. Bennan, and L. W. Enquist, Experiments with Gene Fusions, Cold Spring Harbor Laboratory, Cold Spring Harbor, N.Y., 1984, and by Ausubel, F. M. et al., Current Protocols in Molecular Biology, Greene Publishing Assoc. and Wiley-Interscience, N.Y., 1987.

Materials and methods suitable for the maintenance and growth of bacterial cultures are also well known in the art. Techniques suitable for use in the following Examples can be found in *Manual of Methods for General Bacteriology*, Philipp Gerhardt, R. G. E. Murray, Ralph N. Costilow, Eugene W. Nester, Willis A. Wood, Noel R. Krieg and G. Briggs Phillips, eds., American Society for Microbiology, Washington, D.C., 1994, or by Thomas D. Brock in *Biotechnology: A Textbook of Industrial Microbiology*, Second Edition, Sinauer Associates, Inc., Sunderland, Mass., 1989. All reagents, restriction enzymes and materials used for the growth and maintenance of bacterial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.), unless otherwise specified.

The meaning of abbreviations used is as follows: "A" means Angstrom, "min" means minute(s), "h" means hour(s), "µl" means microliter(s), "ng/µl" means nano gram per microliter, "pmol/µl" means pico mole per microliter, "ml" means milliliter(s), "L" means liter(s), "g/L" mean gram per liter, "ng" means nano gram, "sec" means second(s), "ml/min" means milliliter per minute(s), "w/v" means weight per volume, "v/v" means volume per volume, "nm" means nanometer(s), "mm" means millimeter(s), "cm" means centimeter(s), "mM" means millimolar, "M" means molar, "g" means gram(s), "µg" means microgram(s), "mg" means milligram(s), "g" means the gravitation constant, "rpm" means revolutions per minute, "HPLC" means high performance liquid chromatography, "MS" means mass spectrometry, "HPLC/MS" means high performance liquid chromatography/mass spectrometry, "EDTA" means ethylendiamine-tetraacetic acid, "dNTP" means deoxynucleotide triphosphate, "° C." means degrees Celsius, and "V" means voltage.

High Throughput Screening Assay of Gene Libraries

High throughput screening of the gene libraries of mutant KARI enzymes was performed as described herein (with the exception of Examples 16 and 21): 10× freezing medium containing 554.4 g/L glycerol, 68 mM of $(NH_4)_2SO_4$, 4 mM $MgSO_4$, 17 mM sodium citrate, 132 mM $KH_2PO_4$, 36 mM $K_2HPO_4$ was prepared with molecular pure water and filter-sterilized. Freezing medium was prepared by diluting the 10× freezing medium with the LB medium. An aliquot (200 µl) of the freezing medium was used for each well of the 96-well archive plates (cat #3370, Corning Inc. Corning, N.Y.).

Clones from the LB agar plates were selected and inoculated into the 96-well archive plates containing the freezing medium and grown overnight at 37° C. without shaking. The archive plates were then stored at −80° C. *E. coli* strain Bw25113 transformed with pBAD-HisB (Invitrogen) was always used as the negative control. The positive controls for the libraries in Examples 3, 4, and 5 are the wild type K9-KARI, AB1D3, AB1D3 respectively.

Clones from archive plates were inoculated into the 96-deep well plates. Each well contained 3.0 µl of cells from thawed archive plates, 200 µl of the LB medium containing 100 µg/ml ampicillin and 0.02% (w/v) arabinose as the inducer. Cells were the grown overnight at 37° C. with 80% humidity while shaking (900 rpm), harvested by centrifugation (4000 rpm, 5 min at 25° C.). (Eppendorf centrifuge, Brinkmann Instruments, Inc. Westbury, N.Y.) and the cell pellet was stored at −20° C. for later analysis. The assay substrate, (R,S)-acetolactate, was synthesized as described by Aulabaugh and Schloss (Aulabaugh and Schloss, Biochemistry, 29: 2824-2830, 1990). All other chemicals used in the assay were purchased from Sigma.

The enzymatic conversion of acetolactate to α,β-dihydroxy-isovalerate by KARI was followed by measuring the disappearance of the cofactor, NADPH or NADH, from the reaction at 340 nm using a plate reader (Molecular Device, Sunnyvale, Calif.). The activity was calculated using the molar extinction coefficient of 6220 $M^{-1}cm^{-1}$ for either NADPH or NADH. The stock solutions used were: $K2HPO_4$ (0.2 M); $KH_2PO_4$ (0.2 M); EDTA (0.5 M); $MgCl_2$ (1.0 M); NADPH (2.0 mM); NADH (2.0 mM) and acetolactate (45 mM). The 100 ml reaction buffer (pH 6.8) containing: 2.0 ml $K_2HPO_4$, 3.0 ml $KH_2PO_4$, 4.0 ml $MgCl_2$, 0.1 ml EDTA and 90.9 ml water was prepared.

Frozen cell pellet in deep-well plates and BugBuster were warmed up at room temperature for 30 min at the same time. Each well of 96-well assay plates was filled with 120 µl of the reaction buffer and 20 µl of NADH (2.0 mM). 75 µl of 50% BugBuster (v/v in water) was added to each well after 30 min warm-up and cells were suspended using plate shaker. The plates were incubated at room temperature for 20 min. An aliquot (15 to 25 µl depending the expected activity) of cell lysate was transferred into each well of 96-well assay plates. Absorbance at 340 nm was recorded as background, 16 µl of acetolactate (4.5 mM, diluted with the reaction buffer) was added to each well and mixed with shaking by the plate reader. Absorbance at 340 nm was recorded at 0, and 10 to 30 minutes depending the expected activity after substrate addition. The difference in absorbance (before and after substrate addition) was used to determine the activity of the mutants. Mutants with higher KARI activity compared to the positive control were selected for re-screening.

The number of clones screened for the libraries in Example 1, 2 and 3 are about 12,000, 12,000 and 92 respectively. The top performers from each library were re-screened described below as secondary assay.

Secondary Assay of Active Mutants

Cells containing selected mutants identified by high throughput screening (above) were grown overnight, at 37° C., in 3.0 ml of the LB medium containing 100 µg/ml ampicillin and 0.025% (w/v) arabinose as the inducer while shaking at 250 rpm. The cells were then aliquoted into 96 deepwell plates (200 µl per well) and harvested by centrifugation at 4,000×g for 5 min at room temperature. 75 µl of 50% Bug-Buster (v/v in water) was added to each well and cells were suspended using plate shaker. The plates were incubated at room temperature for 20 min. An aliquot (15 to 25 µl depending the expected activity) of cell lysate was transferred into each well of 96-well assay plates, which contain 120 µl of the reaction buffer and 20 µl of NADH (2.0 mM) per well. Absorbance at 340 nm was recorded as background, 16 µl of acetolactate (4.5 mM, diluted with the reaction buffer) was added to each well and mixed with shaking by the plate reader. Absorbance at 340 nm was recorded at 0, and 5 to 10 minutes depending the expected activity after substrate addition. The difference in absorbance (before and after substrate addition) was used to determine the activity of the mutants. Mutants with higher KARI activity compared to the positive control were selected for further characterization.

Measurement of NADH and NADPH Michaelis Constants

KARI enzyme activity can be routinely measured by NADH or NADPH oxidation as described above, however to measure the Michaelis constant ($K_M$) for these pyridine nucleotides formation of the 2,3-dihydroxyisovalerate product was measured directly using HPLC/MS.

Protein concentration of crude cell extract from Bugbuster lysed cells (as described above) was measured using the Bio-Rad protein assay reagent (BioRad Laboratories, Inc., Hercules, Calif. 94547). Between 0.2 and 1.0 micrograms of crude extract protein was added to a reaction buffer consisting of 100 mM MOPS KOH, pH 6.8, 10 mM $MgCl_2$, 1 mM EDTA, 1 mM glucose-6-phosphate (Sigma-Aldrich), 0.2 Units of *Leuconostoc mesenteroides* glucose-6-phosphate dehydrogenase (Sigma-Aldrich), and various concentrations of NADH or NADPH, to a volume of 90 µL. The reaction was initiated by the addition of 10 µL of [S]-acetolactate to a final concentration of 2.5 mM and a final volume of 100 µL. After 10 min incubations at 30° C., the reaction was quenched by withdrawing 50 µL of the reaction mixture and adding it to 150 µL of 0.1% formic acid. To measure the $K_M$ of NADH and NADPH, the concentrations used were 0.0003, 0.001, 0.003, 0.01, 0.03, 0.1, 0.3 and 1 mM.

To analyze for 2,3-dihydroxyisovalerate, 2 µL of the formic acid quenched reaction mixture was injected into a Waters Acquity HPLC equipped with Waters SQD mass spectrometer (Waters Corporation, Milford Mass.). The chromatography conditions were: flow rate (0.5 ml/min), on a Waters Acquity HSS T3 column (2.1 mm diameter, 100 mm length). Buffer A consisted of 0.1% (v/v) in water, Buffer B was 0.1% formic acid in acetonitrile. The sample was analyzed using 1% buffer B (in buffer A) for 1 min, followed by a linear gradient from 1% buffer B at 1 min to 75% buffer B at 1.5 min. The reaction product, 2,3-dihydroxyisovalerate, was detected by ionization at m/z=133, using electrospray ionization −30 V cone voltage. The amount of product 2,3-dihydroxyisovalerate was calculated by comparison to an authentic standard.

To calculate the $K_M$ for NADH and NADPH, the rate data for DHIV formation measured in assays at a fixed concentration of S-acetolactate (2.5 mM) was fitted to the single substrate Michaelis-Menten equation, using a least-squares regression in Microsoft Excel, assuming saturating acetolactate concentration.

Figure 4:
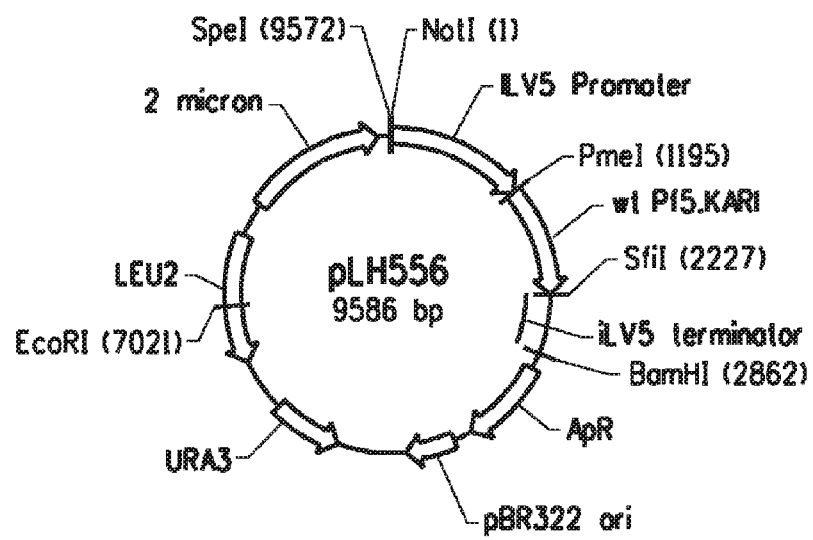
FIG. 4 is a plasmid map of pLH556 (pHR81-PIlv5-Pf5.KARI) vector (SEQ ID NO: 138).

Construction of Plasmids pYZ058, pLH550, pLH556, and pLH702 pYZ058 (pHR81-$P_{CUP1}$-AlsS-$P_{ILV5}$-yeast KARI; SEQ ID NO: 176) was derived from pYZ090 (pHR81-$P_{CUP1}$-AlsS-$P_{ILV5}$-lactis KARI; SEQ ID NO: 195). pYZ090 was cut with PmeI and SfiI enzymes, and ligated with a PCR product of yeast KARI. The PCR product was amplified from genomic DNA of Saccharomyces cerevisiae BY4741 (Research Genetics Inc.) strain using upper primer 5'-catcatcacagtttaaa-cagtatgttgaagcaaatcaacttcggtgg-3' (SEQ ID NO: 272) and lower primer 5'-ggacgggccctgcaggccttattg-gttttctggtctcaactttctgac-3' (SEQ ID NO; 273), and digested with PmeI and SfiI enzymes. pYZ058 was confirmed by sequencing.

pLH550 (pHR81-PCUP1-AlsS-PILV5-Pf5.KARI, SEQ ID NO: 175) was derived from pYZ058 (SEQ ID NO: 176). The wild type Pf5.KARI gene was PCR amplified with OT1349 (5'-catcatcacagtttaaacagtat-gaaagttttctacgataaagactgcgacc-3'; SEQ ID NO: 177) and OT1318 (5'-gcacttgataggcctgcagggccttagt-tcttggctttgtcgacgattttg-3'; SEQ ID NO: 178) digested with PmeI and SfiI enzymes and ligated with pYZ058 vector cut with PmeI and SfiI. The vector generated, pLH550, was confirmed by sequencing.

pLH556 (SEQ ID NO: 138: FIG. 4) was derived from pLH550 by digesting the vector with SpeI and NotI enzymes, and ligating with a linker annealed from OT1383 (5'-ctagt-caccggtggc-3', SEQ ID NO: 179) and OT1384 (5'-ggccgccac-cggtga-3', SEQ ID NO: 180) which contains overhang sequences for SpeI and NotI sites. This cloning step eliminates the AlsS gene and a large fragment of the PCUP1 promoter, with 160 bp residual upstream sequence that is not functional. pLH556 was confirmed by sequencing.

pHR81::ILV5p-K9D3 (pLH702, SEQ ID NO: 181) was derived from pLH556. The K9D3 mutant KARI gene was excised from vector pBAD-K9D3 using PmeI and SfiI enzymes, and ligated with pLH556 at PmeI and SfiI sites, replacing the Pf5.KARI gene with the K9D3 gene. The constructed vector was confirmed by sequencing.

Example 1

Construction of Yeast Isobutanol Pathway Strains Containing Various KARI Genes

To identify polypeptides having KARI activity and performance in yeast isobutanol production, biodiversity screening of KARI-encoding genes from various bacterial and fungal species was carried out. The KARI genes were codon optimized based on codon preferences of Saccharomyces cerevisiae genes where indicated in Table 10. For each KARI gene, a PmeI restriction site and additional 3 bp (AGT) was added to the 5' end with the sequence 5'-<u>GTTTAAAC</u>AGT-3' (SEQ ID NO: 136) before the ATG start codon, and a SfiI restriction site was added to the 3' end with the sequence 5'-GGCCCTGCA<u>GGCC</u>-3' (SEQ ID NO: 137). All of the KARI genes were synthesized by GenScript USA Inc. (Piscataway, N.J.). Each KARI gene was subcloned into pHR81-$P_{CUP1}$-AlsS-$P_{Ilv5}$-Pf5.Ilv5 vector (SEQ ID NO: 175) via the PmeI and SfiI sites (Ilv5 encodes for yeast ketol-acid reductoisomerase). This vector contains two expression cassettes: Bacillus subtilis acetolactate synthase (AlsS) gene under the yeast CUP1 promoter, and yeast Ilv5 gene controlled by the Ilv5 promoter. Sequence analysis was performed to confirm the KARI gene sequences.

The pHR81-PCUP1-AlsS-PI$_{Ilv5}$-KARI vectors carrying the KARI genes were co-transformed with pLH468 (pRS423-$P_{FBA1}$-DHAD-$P_{TDH3}$-kivD-$P_{GPM1}$-hADH1; SEQ ID NO: 139) into host strain BP1135 (PNY1505: Example 8) (CEN.pk 113-7D delta ura3::loxP delta his3 delta pdc6 delta pdc1::ilvD.Sm delta pdc5::sadB delta gpd2::loxP delta fra2). The yeast transformants were selected on minimum drop-out media plates (SE-Ura-His, 2% ethanol) after 5-7 days at 30° C., and restreaked on SE-Ura-His to obtain cell patches after additional 3 day incubation. The cell patches were used for shake flask inoculation.

Example 2

Screening the KARI Diversity Collection for Isobutanol Production

The various KARI genes were evaluated based on their "effective productivities" in yeast. The effective productivity was determined after a certain period of growth under progressively oxygen-limited conditions (e.g. 48 h). The yeast biomass was calculated with the assumption that 1 $OD_{600}$ of yeast cells is equivalent to 0.3 g/L.

The yeast isobutanol pathway strains carrying various KARI genes were inoculated into 10 mL SEG-Ura,His media with 0.2% glucose and 0.2% ethanol, and grown aerobically overnight at 30° C., to about 2 OD. The cultures were centrifuged and a portion of the cells were resuspended in SEG-Ura,His (2% glucose, 1% ethanol) to an initial $OD_{600}$ of 0.4 in 25 mL total volume in a 125 mL shake flask. The shake flasks were dosed with a screw-on solid plastid cap, and the cultures were grown under progressively oxygen-limited conditions in the flask under minimal air and oxygen exchange with the outside environment. After 48 h incubation at 30° C., 250 RPM, the cultures were removed for $OD_{600}$ measurement and HPLC analysis to measure isobutanol production.

From the KARI genes screened, as shown below, multiple had comparable or better isobutanol titers than Lactococcus lactis KARI. In particular, the K9 (Anaerostipes caccae DSM 14662) KARI clone showed a high isobutanol titer and effective isobutanol productivity, as measured after 48 h of growth under progressively oxygen-limited conditions (Table 10).

TABLE 10

Isobutanol titers and effective productivities from yeast isobutanol production strains carrying various KARI genes measured after 48 h of growth under progressively oxygen-limited conditions in shake flasks at 30° C.

| KARI clone | SEQ ID NO: (nucleic acid, amino acid) *All nucleic acid seqs except LTS and S2 are codon-optimized | Iso-butanol titer (g/L) | Effective Isobutanol Productivity (g/g) | Source Organism |
|---|---|---|---|---|
| B3K01 ("K1") | 140, 141 | 2.6 | 4.1 | *Bifidobacterium angulatum* DSM 20098 |
| B3K02 ("K2") | 142, 143 | 3.5 | 3.7 | *Bifidobacterium dentium* ATCC 27678 |
| B3K09 ("K9") | 26, 27 | 4.3 | 5.2 | *Anaerostipes caccae* DSM 14662 |
| B3K25 ("K25") | 375, 376 | 3.6 | 4.4 | *Enterococcus gallinarum* EG2 |
| B3K26 ("K26") | 381, 382 | 4.4 | 3.2 | *Streptococcus thermophilus* LMD-9 |
| B3K29 ("K29") | 377, 378 | 4.1 | 3.3 | *Lactococcus lactis* subsp. *cremoris* MG1363 |
| LTS | 379, 380 | 2.7 | 3.1 | *Lactococcus lactis* |
| B3K07 ("K7") | 274, 275 | 3.7 | 2.8 | *Clostridium beijerinckii* NCIMB 8052 |
| S2 | 276, 277 | 3.6 | 1.5 | *Zymomonas mobilis* |

Example 3

KARI Enzyme Analysis of the Yeast Isobutanol Pathway Strains

IpOHA (N-isopropyl oxalylhydroxamic acid) is a mimic of a reaction intermediate for the reaction catalyzed by the KARI enzyme. It is a tight binding inhibitor that binds to the active site of the KARI enzyme. The synthesis of IpOHA and its tight binding to KARI from *E. coli* is described in literature (A. Aulabaugh and J. V. Schloss, Biochemistry, 1990, 29, 2824-2830). Its use for active site titration has not been reported before. IpOHA was synthesized from [$^{14}$C]-oxalate according to literature.

The yeast cultures from Example 2 were harvested and analyzed for KARI enzyme activities. 25 mL of the cultures was pelleted and resuspended in 10 mL of 50 mM Tris-HCl, pH 7.5. The cells were centrifuged again to remove the buffer and the cell pellets are stored at −70 C. The cell pellets were resuspended in 1 mL of 50 mM Tris-HCl pH 7.5 and sonicated. Soluble crude cell extracts were used to perform the enzyme assays. A portion of enzyme was incubated with a molar excess of [$^{14}$C]-IpOHA, and saturating concentrations of NAD(P)H and $Mg^{2+}$. Because a reversible, dilution-sensitive complex forms first, extract concentrations were kept high, to favor complexation and thus reduce the time taken for tight complex formation. Because it was not known a priori how long it would take each KARI to form the tight complex, two time points were taken for each sample to verify that the results agree. At the end of the incubation time, small molecules were separated from protein molecules by ultrafiltration using Microcon® (Millipore Inc., Billerica, Mass.), and the high molecular weight fraction was counted. The concentration of KARI in the sample in either μM or mg/ml was back-calculated from the $^{14}$C dpm, the volumes, and the KARI subunit molecular weight. A fixed-time enzyme assay was run concurrently, and the data were used to calculate U/ml. The specific activity was calculated by dividing U/ml by mg/ml for a given sample. The assumption made was that full activity and the ability to bind IpOHA are strictly correlated. The specific activities of the KARI enzymes thus measured are listed in Table 11. The KARI activity in "Units per mg" represents the activity per milligram of KARI enzyme as quantitated using the IpOHA assay. Total protein concentration was determined by the Bradford method, and the expression level of KARI is calculated by dividing KARI enzyme amount by the amount of total soluble cellular proteins.

TABLE 11

KARI enzyme activities measured by the IPOHA assay

| KARI clone | KARI activity U/mg | KARI % total protein | Organism |
|---|---|---|---|
| B3K01 | 0.56 | 21 | *Bifidobacterium angulatum* DSM 20098 |
| B3K02 | 0.44 | 28 | *Bifidobacterium dentium* ATCC 27678 |
| B3K09 | 2.4 | 15 | *Anaerostipes caccae* DSM 14662 |
| B3K25 | 1.3 | 21 | *Enterococcus gallinarum* EG2 |
| B3K26 | 1.5 | 17 | *Streptococcus thermophilus* LMD-9 |
| B3K29 | 1.6 | 14 | *Lactococcus lactis* subsp. *cremoris* MG1363 |
| LTS | 0.8 | 23.0 | *Lactococcus lactis* |

Example 4

Construction of a Site-Saturation Gene Library to Identify Variants Utilizing NADH with $K_M$ Lower than Wild Type To construct the pBAD-based bacterial expression vector for K9 KARI, the K9 KARI gene (synthesized by Genscript, Piscataway, N.J.) was subcloned into pBAD-ps-JEA1 vector (SEQ ID NO: 905) via the PmeI and SfiI sites. The ketol-acid reductoIsomerase (KARI) from *Anaerostipes caccae* (called K9-KARI) was used for the library construction. One gene library was constructed using the commercially available kits, T4 polynucleotide kinase (PNK) (USB Corporation, Cleveland, Ohio, #70031Z) and Chang_IT Multiple Mutation Site Directed Mutagenesis Kit (USB Corporation, Cleveland, Ohio, #78480).

The oligonucleotides (K9_56_58_060210f: GAAG-GANNKAAANNKTGGAAGAGAGC, SEQ ID NO: 144; and K9_56_58_060210r: GCTCTCTTCCAMNNTTT-MNNTCCTTC, SEQ ID NO: 145) were synthesized by Integrated DNA Technologies, Inc (Coralville Iowa). They were first phosphorylated by T4 PNK. In brief, A 30 μl reaction mixture contained: 3.0 μl of 10×T4 PNK buffer supplied with the kit, 4.0 μl of primer (about 35 μM), 0.8 μl of 100 mM ATP mix, 0.6 μl T4 PNk and 22 μl of water. The reaction mixture was incubated at 37° C. for 1.0 hr and T4 PNK was then deactivated at 65° C. for 20 min.

The phosphorylated primers were then directly used for the subsequent PCR reaction to introduce the mutations at two sites into K9 KARI wild type using the kit. In brief, a 30 μl reaction mixture contained: 3.0 μl of 10× reaction buffer supplied with the kit, 3.0 μl of phosphorylated forward primer and reverse primer, 2.0 μl of K9 KARI wild type (50 ng/μl), 1.2 μl Chang_IT enzyme and 17.8 μl of water. This reaction mixture was placed into thin well 200 μl-capacity PCR tubes and the following PCR reaction program were used for the PCR: The starting temperature was 95° C. for 2 min followed by 30 heating/cooling cycles. Each cycle consisted of 95° C. for 30 sec, 55° C. for 30 sec, and 68° C. for 20 min. At the completion of the temperature cycling, the samples were kept at 68° C. for 25 min more, and then held at 4° C. for later processing. The PCR reaction was cleaned up using the Zymo DNA clean-up kit (Zymo Research Corporation, Orange Calif., #D4004). DNA was eluted out of membrane using 84 µl of water. The DNA template was removed with Dpn (Promega, Madison Wis., #R6231) at 37° C. for 3 hr (reaction mixture: 10 µl of 10× reaction buffer, 1.0 µl BSA, 6.0 µl of Dpn I and 83 µl cleaned PCR DNA). The Dpn I digested DNA was cleaned up again with Zymo DNA clean-up kit and digested again with Dpn I to completely remove the DNA template (reaction mixture: 1.5 µl of 10× reaction buffer, 0.15 µl BSA, 0.85 µl of Dpn I and 83 µl cleaned PCR DNA). The reaction mixture was directly used to transform an electro-competent strain of *E. coli* Bw25113(ΔilvC) (described in U.S. Pat. No. 8,129,162, which is herein incorporated by reference in its entirety) using a BioRad Gene Pulser II (Bio-Rad Laboratories Inc., Hercules, Calif.). The transformed clones were streaked on agar plates containing the LB medium and 100 µg/ml ampicillin (Cat #L1004, Teknova Inc, Hollister, Calif.) and incubated at 37° C. overnight. Clones were screened for activity using NADH. $K_M$ for the variants was measured (Table 12).

TABLE 12

Kinetic Values for K9 KARI Variants in *E. coli* Extracts, as Determined via DHIV Formation Assays

| Mutant | SEQ ID NO: (nucleic acid, amino acid) | Mutations | $K_M$ (µM) (NADH) | $K_M$ (µM) (NADPH) |
|---|---|---|---|---|
| K9 Wt | 26, 27 |  | 326 | 0.2 |
| AB1D1 | 28, 29 | S56A | 164 | 1 |
| 495B5 | 30, 31 | S56A/S58H | 44 | 4 |
| AB1D3 (also referred to as "K9D3") | 32, 33 | S56A/S58D | 38 | 9 |
| AB1G9 (also referred to as "K9G9") | 34, 35 | S56AS58E | 47 | 23 |

Example 5

Construction of Site Saturation Gene Libraries to Lower $K_M$ for NADH

Based on work with *Pseudomonas fluorescens* KARI (PF5-KARI) positions 24, 33, 61, 80, 156 and 170 were targeted as mutagenesis targets for K9 KARI. Through multiple sequence alignment (MSA) between PF5-KARI and K9 KARI (FIG. 2), the corresponding positions are 30, 39, 67, 86, 162, and 176.

To identify more mutagenesis targets, MSA of existing KARI enzymes (K1, K2, K7, K9, K25, K26, *L. Lactis* and S2), determined to produce isobutanol in a butanologen strain (see other examples) was used to identify more mutagenesis targets. Positions 41, 87, 131, 191, 227, and 246 were selected as mutagenesis targets.

The oligonucleotides targeting positions 30, 39, 41, 67, 86, 87, 131, 162, 176, 191, 227, and 246 were commercially synthesized by Integrated DNA Technologies, Inc (Coralville Iowa) (Table 13). Eight pairs of oligonucleotides targeting positions 30, 67, 131, 162, 176, 191, 227, and 246 were used to generate Megaprimers using Supermix from Invitrogen (Cat #10572-014, Invitrogen, Carlsbad, Calif.). For each PCR reaction, a pair of primers, any combination of one forward primer and one reverse primer encoding different positions from those eight pairs of oligonucleotides (e.g. K9_30_101110f and K9_67_101110r), were used. There are total $P_8^2$ or 56 combinations. A 25 µl reaction mixture contained: 22.5 µl of Supermix solution, 1.0 µl of forward primer and 1.0 µl of reverse primer, 0.5 µl of AB1D3 DNA template (50 ng/µl). The mixture was placed in a thin well 200 µl tube for the PCR reaction in a Mastercycler gradient equipment (Brinkmann Instruments, Inc. Westbury, N.Y.). The following conditions were used for the PCR reaction: The starting temperature was 95° C. for 1.0 min followed by 35 heating/cooling cycles. Each cycle consisted of 95° C. for 20 sec, 55° C. for 20 sec, and 72° C. for 1.0 min. At the completion of the temperature cycling, the samples were kept at 72° C. for 2.0 min more, and then held awaiting sample recovery at 4° C. The PCR product was cleaned up using a DNA cleaning kit (Cat #D4003, Zymo Research, Orange, Calif.) as recommended by the manufacturer.

The Megaprimers were then used to generate gene libraries using the QuickChange II XL site directed mutagenesis kit (Catalog #200524, Stratagene, La Jolla Calif.). A 25 µl reaction mixture contained: 2.5 µl of 10× reaction buffer, 1.0 µl of 50 ng/µl template, 20.5 of Megaprimer, 0.5 of 40 mM dNTP mix, 0.5 µl pfu-ultra DNA polymerase. Except for the Megaprimer and the templates, all reagents used here were supplied with the kit indicated above. This reaction mixture was placed in a thin well 200 µl-capacity PCR tube and the following reactions were used for the PCR: The starting temperature was 95° C. for 30 sec followed by 25 heating/cooling cycles. Each cycle consisted of 95° C. for 30 sec, 55° C. for 1 min, and 68° C. for 6 min. At the completion of the temperature cycling, the samples were kept at 68° C. for 8 min more, and then held at 4° C. for later processing. The PCR reaction mixture was processed with Dpn I restriction enzyme same as that used in Example 4.

The oligonucleotides K9_37&39_101110f, K9_37&39_101110r and K9_86&87_101110f, K9_86&87_101110r were directly then used to generate gene libraries using the QuickChange II XL site directed mutagenesis kit. Two 25 d reaction mixtures for the two oligonucleotide sets. each 25 µl reaction mixture contained: 2.5 µl of 10× reaction buffer, 1.0 µl of 50 ng/µl template, 1.0 µl of forward primer, 1.0 µl reverse primer, 0.5 µl of 40 mM dNTP mix, 0.5 µl pfu-ultra DNA polymerase and 18.5 µl of water. The PCR program and the subsequent Dpn I processing are the same.

The Dpn I processed DNA mixture was cleaned up using Zymo DNA clean-up kit following the manufacturers protocol. The cleaned-up DNA was used to transform an electro-competent strain of *E. coli* Bw25113 (ΔilvC) using a BioRad Gene Pulser II (Bio-Rad Laboratories Inc., Hercules, Calif.). The transformed clones were streaked on agar plates containing the LB medium and 100 µg/ml ampicillin (Cat #L1004, Teknova Inc. Hollister, Calif.) and incubated at 37° C. overnight. Clones were screened for improved activity using NADH. $K_M$ for the improved mutants was measured (Table 14).

TABLE 13

Primers

| Targeted position(s) of K9-KARI | Primers |
|---|---|
| 30 | K9_30_101110f: gactatcgccgttatcggtNNKggttctcaaggtcac<br>SEQ ID NO: 146<br>K9_30_101110r: GTGACCTTGAGAACCMNNACCGATAACGGCGATAGTC<br>SEQ ID NO: 147 |
| 67 | K9_67_101110f: gagctgaagaacaaggtNNKgaagtctacaccgctgc<br>SEQ ID NO: 148<br>K9_67_101110r: GCAGCGGTGTAGACTTCMNNACCTTGTTCTTCAGCTC<br>SEQ ID NO: 149 |
| 131 | K9_131_101110f: caaaggacgttgatgtcNNKatgatcgctccaaag<br>SEQ ID NO: 150<br>K9_131_101110r: CTTTGGAGCGATCATMNNGACATCAACGTCCTTT<br>SEQ ID NO: 151 |
| 162 | K9_162_101110f: gctgtcgaacaagacNNKactggcaaggctttg<br>SEQ ID NO: 152<br>K9_162_101110r: CAAAGCCTTGCCAGTMNNGTCTTGTTCGACAGC<br>SEQ ID NO: 153 |
| 176 | K9_176_101110f: gctttggcctacgctttaNNKatcggtggtgctagagc<br>SEQ ID NO: 154<br>K9_176_101110r: GCTCTAGCACCACCGATMNNTAAAGCGTAGGCCAAAGC<br>SEQ ID NO: 155 |
| 191 | K9_191_101110f: gaaactaccttcagaNNKgaaactgaaaccgac<br>SEQ ID NO: 156<br>K9_191_101110r: GTCGGTTTCAGTTTCMNNTCTGAAGGTAGTTTC<br>SEQ ID NO: 157 |
| 227 | K9_227_101110f: gccggttacgacccaNNKaacgcttacttcgaatg<br>SEQ ID NO: 158<br>K9_227_101110r: CATTCGAAGTAAGCGTTMNNTGGGTCGTAACCGGC<br>SEQ ID NO: 159 |
| 246 | K9_246_101110f: gttgacttgatctacNNKtctggtttctccggtatgc<br>SEQ ID NO: 160<br>K9_246_101110r: GCATACCGGAGAAACCAGAMNNGTAGATCAAGTCAAC<br>SEQ ID NO: 161 |
| 39, 41 | K9_37 & 39_101110f: gttctcaaggtcacgctNNKgccNNKaatgctaaggaatcc<br>SEQ ID NO: 162<br>K9_37 & 39_101110r: GGATTCCTTAGCATTMNNGGCMNNAGCGTGACCTTGAGAAC<br>SEQ ID NO: 163 |
| 86, 87 | K9_86 & 87_101110f: gacatcattatgatcttgNNKNNKgatgaaaagcaggc<br>SEQ ID NO: 164<br>K9_86 & 87_101110r: GCCTGCTTTTCATCMNNMNNCAAGATCATAATGATGTC<br>SEQ ID NO: 165 |

TABLE 14

List of some mutants with their measured $K_M$ values

| Mutant | SEQ ID NO: (nucleic acid, amino acid) | Mutations | $K_M$ (μM) (NADH) | $K_M$ (μM) (NADPH) |
|---|---|---|---|---|
| AO7A9 | 38, 39 | S56A/S58D/I86T/N87P | 15 | 7 |
| AO7B5 | 36, 37 | S56A/S58D/I86V/N87P | 8 | 4 |
| AO7H8 | 40, 41 | S56A/S58D/N87P | 8 | 6 |
| AO7D8 | 42, 43 | S56A/S58D/T131C/T191S | 26 | 6 |
| AO7F7 | 44, 45 | S56A/S58D/T131V/T191A | 28 | 7 |
| AO7H7 | 46, 47 | S56A/S58D/T191S | 29 | 8 |

Example 6

Construction of a Combinatorial Library to Lower $K_M$ or NADH

Based on the mutagenesis results (Example 4), T131L, T131A, T131V, T131M, T131C, T191D, T191C, T191S, and T191G are considered as beneficial mutations to improve $K_M$ for NADH. A combinatorial library to introduce these beneficial mutations into AO7B5 was made.

All oligonucleotides were synthesized by the Integrated DNA Technologies, Inc (Coralville Iowa). They were first phosphorylated by T4 PNK. In brief, a 20 μl reaction mixture contained: 2.0 μl of 10×T4 PNK buffer supplied with the kit, 2.85 of primer (about 35 μM, 0.6 μl of 100 mM ATP mix, 0.4 μl T4 PNK and 14.15 μl of water. The reaction mixture was incubated at 37° C. for 1.0 hr and T4 PNK was then deactivated at 65° C. for 20 min.

The phosphorylated primers were then directly used for the subsequent PCR reaction to introduce the mutations at two sites into AO7B5 using the kit. In brief, a 50 reaction mixture contained: 5.0 µl of 10× reaction buffer supplied with the kit, 2.5 µl of phosphorylated forward primer (0.5 µl of each forward primer shown in Table 15), 2.5 µl reverse primer (0.625 µl of each forward primer shown at Table 15), 2.5 µl of AO7B5 (50 ng/µl), 2.5 µl Chang_IT enzyme and 35 µl of water. This reaction mixture was placed into thin well 200 µl-capacity PCR tubes and the following PCR reaction program were used for the PCR: The starting temperature was 95° C. for 2 min followed by 30 heating/cooling cycles. Each cycle consisted of 95° C. for 30 sec, 55° C. for 30 sec, and 68° C. for 20 min. At the completion of the temperature cycling, the samples were kept at 68° C. for 25 min more, and then held at 4° C. for later processing. The PCR reaction was cleaned up using the Zymo DNA clean-up kit (Zymo Research Corporation, Orange Calif., #D4004). DNA was eluted out of membrane using 84 µl of water. The DNA template was removed with Dpn I (Promega, Madison Wis., #R6231) at 37° C. for 3 hr (reaction mixture: 10 µl of 10× reaction buffer, 1.0 µl BSA, 6.0 of Dpn I and 83 µl cleaned PCR DNA). The Dpn I digested DNA was cleaned up again with Zymo DNA clean-up kit and digested again with Dpn I to completely remove the DNA template (reaction mixture: 1.5 µl of 10× reaction buffer, 0.15 µl BSA, 0.85 µl of Dpn I and 83 µl cleaned PCR DNA).

The Dpn I processed DNA mixture was cleaned up using Zymo DNA clean-up kit following the manufacturer's protocol. The cleaned-up DNA was used to transform an electrocompetent strain of *E. coli* Bw25113 (ΔilvC) using a BioRad Gene Pulser II (Bio-Rad Laboratories Inc., Hercules, Calif.). The transformed clones were streaked on agar plates containing the LB medium and 100 µg/ml ampicillin (Cat #L1004, Teknova Inc. Hollister, Calif.) and incubated at 37° C. overnight. Clones were screened for improved activity using NADH. $K_M$ for the improved mutants was measured (Table 16).

TABLE 16

List of some mutants with their measured $K_M$ values

| Mutant | SEQ ID NO: (nucleic acid, amino acid) | Mutations | $K_M$ (µM) (NADH) | $K_M$ (µM) (NADPH) |
|---|---|---|---|---|
| AWB9 | 52, 53 | S56A/S58D/I86V/N87P/T131A | 10 | 4 |
| AWC1 | 54, 55 | S56A/S58D/I86V/N87P/T131V | 9 | 3 |
| AWD6 | 62, 63 | S56A/S58D/I86V/N87P/T131V/T191S | 5 | 2 |
| AWD10 | 64, 65 | S56A/S58D/I86V/N87P/T131A/T191C | 8 | 3 |
| AWF4 | 56, 57 | S56A/S58D/I86V/N87P/N107S/T131V | 7 | 3 |
| AWF6 | 58, 59 | S56A/S58D/I86V/N87P/T131V/T191D | 7 | 2 |
| AWG4 | 50, 51 | S56A/S58D/I86V/N87P/T131M | 7 | 3 |
| AWH3 | 60, 61 | S56A/S58D/I86V/N87P/T131V/T191G | 6 | 2 |
| AS6F1 | 48, 49 | S56A/S58D/I86V/N87P/T131M/T191G | 4 | 1 |

Example 7

Isobutanol Production from K9 KARI Variants

The following variants of K9 KARI were generated as described above.

TABLE 17

KARI variants and the corresponding yeast expression vectors

| Clone Names | Yeast Vector Name | Nucleotide Point Mutation Locations | | | | | Amino Acid Mutation Positions |
|---|---|---|---|---|---|---|---|
| | | 166 | 168 | 172 | 173 | 174 | |
| WT K9 KARI | pHR81-PIlv5-KARI-K9 | T | T | T | C | C | S56, S58 |
| AB1G9 | pHR81-PIlv5-KARI-K9.G9 | G | G | G | A | G | S56A, S58E |

TABLE 15

Primers for example 6

| Targeted position(s) of K9-KARI | Primers | | |
|---|---|---|---|
| 131 | K9_131L_112210f: | ggacgttgatgtcTTGatgatcgctcc | SEQ ID NO: 166 |
| | K9_131A_112210f: | ggacgttgatgtcGCAatgatcgctcc | SEQ ID NO: 167 |
| | K9_131V_112210f: | ggacgttgatgtcGTTatgatcgctcc | SEQ ID NO: 168 |
| | K9_131M_112210f: | ggacgttgatgtcATGatgatcgctcc | SEQ ID NO: 169 |
| | K9_131C_112210f: | ggacgttgatgtcTGAatgatcgctcc | SEQ ID NO: 170 |
| 191 | K9_191D_112210r: | GGTTTCAGTTTCGTCTCTGAAGGTAGTTTC | SEQ ID NO: 171 |
| | K9_191C_112210r: | GGTTTCAGTTTCGCCTCTGAAGGTAGTTTC | SEQ ID NO: 172 |
| | K9_191S_112210r: | GGTTTCAGTTTCCGATCTGAAGGTAGTTTC | SEQ ID NO: 173 |
| | K9_191G_112210r: | GGTTTCAGTTTCGCCTCTGAAGGTAGTTTC | SEQ ID NO: 174 |

TABLE 17-continued

KARI variants and the corresponding yeast expression vectors

| Clone Names | Yeast Vector Name | Nucleotide Point Mutation Locations | | | | | Amino Acid Mutation Positions |
|---|---|---|---|---|---|---|---|
| | | 166 | 168 | 172 | 173 | 174 | |
| 495B5 | pHR81-PIlv5-KARI-K9.B5 | G | T | C | A | T | S56A, S58H |
| AB1D3 | pHR81-PIlv5-KARI-K9.D3 | G | T | G | A | T | S56A, S58D |
| AB1D1 | pHR81-PIlv5-KARI-K9.D1 | G | T | T | C | C | S56A |

The yeast expression plasmids were made by subcloning of the variant KARI genes from *E. coli* vectors (pBAD.KARI) into pHR81-PIlv5-Pf5.KARI vector pLH556 (FIG. 4, SEQ ID NO: 138) at PmeI and SfiI sites. Yeast pathway strains were made in PNY2204 host (MATa ura3Δ::loxP his3Δ pdc6Δ pdc1Δ::P[PDC1]-DHAD|ilvD_Sm-PDC1t-pUC19-loxP-kanMX-loxP-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_LI(y)-ADH1t; Example 13) by co-transforming the KARI vectors as pathway plasmid #1, and pBP915 (pRS423-P$_{FBA1}$-DHAD-P$_{GPM1}$-hADH1; SEQ ID NO: 182) as pathway plasmid #2. Transformants were patched to the same medium containing 2% glucose and 0.1% ethanol as carbon sources. Three patches were tested for isobutanol production under microaerobic conditions in serum vials. A done that was transformed with pBP915 and the pLH702 plasmid which expresses K9D3 was designated PNY1910.

Yeast colonies from the transformation on SE-Ura-His plates appeared after 5-7 days. The colonies were patched onto fresh SE-Ura-His plates, incubate at 30° C. for 3 days. The patched cells were inoculated into 25 mL SEG-Ura,His media with 0.2% glucose and 0.2% ethanol and grown aerobically for 1-2 days at 30° C., to 2-3 OD. The cells were centrifuged and re-suspended in 1 mL of SEG-Ura,His media (2% glucose, 0.1% ethanol, 10 mg/L ergosterol, 50 mM MES, pH 5.5, thiamine 30 mg/L, nicotinic acid 30 mg/L). A calculated amount of cells were transferred to 45 mL total volume of the same media for a starting OD=0.2 in a 60 mL serum vial, with the top closed tightly by a crimper. This step was done in the regular bio-hood in air. The serum vials were incubated at 300, 200 rpm for 2 days. At 48 h, the samples were removed for OD and HPLC analysis of glucose, isobutanol and pathway intermediates. 24 h samples were taken in an anaerobic chamber to maintain the anaerobic condition in the serum vials. In the initial phase of the 48 h incubation, the air present in the head space (~15 mL) and the liquid media is consumed by the growing yeast cells. After the oxygen in the head space is consumed, the culture becomes anaerobic. Therefore this experiment includes switching condition from aerobic to oxygen limiting and anaerobic conditions.

Of the four K9 variants, AB1G9 and AB1D3 produced relatively high isobutanol titers, while 495B5 and AB1D1 have lower titer. Wild type K9 KARI strain produced the lowest titer. While not wishing to be bound by theory, it is believed that the lower titer is due to the shifted balance of NADH and NADPH when cells are switched from aerobic to anaerobic conditions. By this rationale, under anaerobic conditions, NADH concentration and availability increased significantly, favoring the variant KARI enzymes that use NADH. Based on the kinetic analysis, AB1G9 ("K9G9") and AB1D3 ("K9D3") mutants have relatively high $K_M$ for NADPH (23 & 9.2 µM), in addition to their relative low $K_M$ for NADH (47 & 38 µM). As comparison, 495B5 and AB1D1's $K_M$'s are 2.5 and 1.1 µM respectively for NADPH, and wt K9's $K_M$ is 0.10 µM. The low NADH $K_M$ of AB1G9 and AB1D3, together with the high NADPH $K_M$ of AB1G9 and AB1D3 may have led to reduced NADPH utilization under anaerobic conditions, and relatively high NADH utilization. As evidence, AB1G9 and AB1D3 have lower glycerol accumulation (isobutanol:glycerol=3.3) compared to 495B5 and AB1D1 (2-3). The isobutanol:glycerol ratio is for the wild type K9 is 1:1 under the same switched aerobic to anaerobic condition.

TABLE 18

Kinetic properties of wild type and variant K9 KARI enzymes, and isobutanol titer and productivity measured from aerobic to anaerobic switch experiment in serum vials.

| Clone Names | NADPH | | NADH | | Isobutanol g/L | Effective Isobutanol Productivity (g/g cells) |
|---|---|---|---|---|---|---|
| | $K_M$ (NADPH) | $V_{max}$ (U/mg) | $K_M$ (NADH) | $V_{max}$ (U/mg) | | |
| WT K9 KARI | 0.19 | 2.0 | 326 | 1.5 | 0.9 | 3.1 |
| AB1G9 | 23 | 2.4 | 47 | 2.0 | 3.4 | 10.5 |
| 495B5 | 3.5 | 2.5 | 44 | 1.9 | 2.2 | 9.2 |
| AB1D3 | 9.2 | 2.1 | 38 | 1.9 | 3.3 | 10.8 |
| AB1D1 | 1.1 | 2.8 | 164 | 2.1 | 2.3 | 9.5 |

Example 8

Construction of *Saccharomyces cerevisiae* Strains BP1135 (PNY1505) and PNY1507 and Isobutanol-Producing Derivatives This example describes construction of *Saccharomyces cerevisiae* strains BP1135 and PNY1507. These strains were derived from PNY1503 (BP1064). PNY1503 was derived from CEN.PK 113-7D (CBS 8340; Centraalbureau voor Schimmelcultures (CBS) Fungal Biodiversiry Centre, Netherlands). BP1135 contains an additional deletion of the FRA2 gene. PNY1507 was derived from BP1135 with additional deletion of the ADH1 gene, with integration of the kivD gene from *Lactococcus lactis*, codon optimized for expression in *Saccharomyces cerevisiae*, into the ADH1 locus.

Deletions/integrations were created by homologous recombination with PCR fragments containing regions of homology upstream and downstream of the target gene and the URA3 gene for selection of transformants. The URA3 gene was removed by homologous recombination to create a scarless deletion/integration.

The scarless deletion/integration procedure was adapted from Akada et al., *Yeast*, 23:399, 2006. In general, the PCR cassette for each deletion/integration was made by combining four fragments, A-B-U-C, and the gene to be integrated by cloning the individual fragments into a plasmid prior to the entire cassette being amplified by PCR for the deletion/integration procedure. The gene to be integrated was included in the cassette between fragments A and B. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C (each approximately 100 to 500 bp long) corresponded to the sequence immediately upstream of the target region (Fragment A) and the 3' sequence of the target region (Fragment C). Fragments A and C were used for integration of the cassette into the chromosome by homologous recombination. Fragment B (500 bp long) corresponded to the 500 bp immediately downstream of the target region and was used for excision of the URA3 marker and Fragment C from the chromosome by homologous recombination, as a direct repeat of the sequence corresponding to Fragment B was created upon integration of the cassette into the chromosome.

FRA2 Deletion

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the starless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). FRA2 Fragment A was amplified with primer oBP594 (SEQ ID NO: 183) and primer oBP595 (SEQ ID NO: 184), containing a 5' tail with homology to the 5' end of FRA2 Fragment B. FRA2 Fragment B was amplified with primer oBP596 (SEQ ID NO: 185), containing a 5' tail with homology to the 3' end of FRA2 Fragment A, and primer oBP597 (SEQ ID NO:186), containing a 5' tail with homology to the 5' end of FRA2 Fragment U. FRA2 Fragment U was amplified with primer oBP598 (SEQ ID NO: 187), containing a 5' tail with homology to the 3' end of FRA2 Fragment B, and primer oBP599 (SEQ ID NO: 188), containing a 5' rail with homology to the 5' end of FRA2 Fragment C. FRA2 Fragment C was amplified with primer oBP600 (SEQ ID NO:189), containing a 5' tail with homology to the 3' end of FRA2 Fragment U, and primer oBP601 (SEQ ID NO:190). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO:183) and oBP597 (SEQ ID NO:186). FRA2 Fragment UC was created by overlapping PCR by mixing FRA2 Fragment U and FRA2 Fragment C and amplifying with primers oBP598 (SEQ ID NO:187) and oBP601 (SEQ ID NO:190). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO:183 and oBP601 (SEQ ID NO:190). The PCR product was purified with a PCR Purification kit (Qiagen).

Competent cells of PNY1503 were made and transformed with the FRA2 ABUC PCR cassette using a Frozen-EZ Yeast Transformation II kit (Zymo Research; Orange, Calif.). Transformation mixtures were plated on synthetic complete media lacking uracil supplemented with 1% ethanol at 30° C. Transformants with a fra2 knockout were screened for by PCR with primers oBP602 (SEQ ID NO:191) and oBP603 (SEQ ID NO:192) using genomic DNA prepared with a Gentra Puregene Yeast/Bact kit (Qiagen). A correct transformant was grown in YPE (yeast extract, peptone, 1% ethanol) and plated on synthetic complete medium containing 5-fluoro-orotic acid (0.1%) at 30° C. to select for isolates that lost the URA3 marker. The deletion and marker removal were confirmed by PCR with primers oBP602 (SEQ ID NO:191) and oBP603 (SEQ ID NO:192) using genomic DNA prepared with a Gentra Puregene Yeast/Bact kit (Qiagen). The absence of the FRA2 gene from the isolate was demonstrated by a negative PCR result using primers specific for the deleted coding sequence of FRA2, oBP605 (SEQ ID NO:193) and oBP606 (SEQ ID NO:194). The correct isolate was selected as strain CEN.PK 113-7D MATa ura3Δ::loxP his3Δ pdc6Δ pdc1Δ::P[PDC1]-DHAD|ilvD_Sm-PDC1t pdc5Δ::P[PDC5]-ADH|sadB_Ax-PDC5t gpd2Δ::loxP fra2Δ and designated as PNY1505 (BP1135).

This strain was transformed with isobutanol pathway plasmids (pYZ090, SEQ ID NO: 195) and pLH468 (SEQ ID NO: 139), and one clone was designated BPI 168 (PNY1506).

pYZ090 (SEQ ID NO: 195) was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI.

ADH1 Deletion and kivD_LI(y) Integration

The ADH1 gene was deleted and replaced with the kivD coding region from *Lactococcus lactis* codon optimized for expression in *Saccharomyces cerevisiae*. The scarless cassette for the ADH1 deletion-kivD_LI(y) integration was first cloned into plasmid pUC19-URA3MCS, as described in U.S. Apple. No. 61/356,379, filed Jun. 18, 2010, incorporated herein by reference. The vector is pUC19 based and contains the sequence of the URA3 gene from *Saccharomyces cerevisiae* CEN.PK 113-7D situated within a multiple cloning site (MCS), pUC19 contains the pMB1 replicon and a gene coding for beta-lactamase for replication and selection in *Escherichia coli*. In addition to the coding sequence for URA3, the sequences from upstream (250 bp) and downstream (150 bp) of this gene are present for expression of the URA3 gene in yeast. The vector can be used for cloning purposes and can be used as a yeast integration vector.

The kivD coding region from *Lactococcus lactis* codon optimized for expression in *Saccharomyces cerevisiae* was amplified using pLH468 (SEQ ID NO:139) as template with primer oBP562 (SEQ ID NO:197), containing a PmeI restriction site, and primer oBP563 (SEQ ID NO:198), containing a 5" tail with homology, to the 5' end of ADH1 Fragment B. ADH1 Fragment B was amplified from genomic DNA prepared as above with primer oBP564 (SEQ ID NO:199), containing a 5' tail with homology to the 3' end of kivD_LI(y), and primer oBP565 (SEQ ID NO:200), containing a FseI restriction site. PCR products were purified with a PCR Purification kit (Qiagen). kivD_LI(y)-ADH1 Fragment B was created by overlapping PCR by mixing the kivD_LI(y) and ADH1 Fragment B PCR products and amplifying with primers oBP562 (SEQ ID NO:197) and oBP565 (SEQ ID NO:200). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO:201), containing a SacI restriction site, and primer oBP506 (SEQ ID NO:202), containing an AscI restriction site. The ADH1 Fragment A PCR product was digested with SacI and AscI and ligated with T4 DNA ligase into the corresponding sites of the plasmid containing kivD_LI(y)-ADH1 Fragment B. ADH1 Fragment C was amplified from genomic DNA with primer oBP507 (SEQ ID NO:203), containing a PacI restriction site, and primer oBP508 (SEQ ID NO:204), containing a SalI restriction site. The ADH1 Fragment C PCR product was digested with PacI and SalI and ligated with T4 DNA ligase into the corresponding sites of the plasmid containing ADH1 Fragment A-kivD_LI(y)-ADH1 Fragment B. The hybrid promoter UAS(PGK1)-$P_{FBA1}$ was amplified from vector pRS316-UAS(PGK1)-$P_{FBA1}$-GUS (SEQ ID NO:209) with primer oBP674 (SEQ ID NO:205), containing an AscI restriction site, and primer oBP675 (SEQ ID NO:206), containing a PmeI restriction site. The UAS(PGK1)-$P_{FBA1}$ PCR product was digested with AscI and PmeI and ligated with T4 DNA ligase into the corresponding sites of the plasmid containing kivD_LI(y)-ADH1 Fragments ABC. The entire integration cassette was amplified from the resulting plasmid with primers oBP505 (SEQ ID NO:201) and oBP508 (SEQ ID NO:204) and purified with a PCR Purification kit (Qiagen).

Competent cells of PNY1505 were made and transformed with the ADH1-kivD_LI(y) PCR cassette constructed above using a Frozen-EZ Yeast Transformation II kit (Zymo Research). Transformation mixtures were plated on synthetic complete media lacking uracil supplemented with 1% ethanol at 30° C. Transformants were grown in YPE (1% ethanol) and plated on synthetic complete medium containing 5-fluoroorotic acid (0.1%) at 30° C. to select for isolates that lost the URA3 marker. The deletion of ADH1 and integration of kivD_LI(y) were confirmed by PCR with external primers oBP495 (SEQ ID NO:207) and oBP496 (SEQ ID NO:208) and with kivD_LI(y) specific primer oBP562 (SEQ ID NO:197) and external primer oBP496 (SEQ ID NO:208) using genomic DNA prepared with a Gentra Puregene Yeast/Bact kit (Qiagen). The correct isolate was selected as strain CEN.PK 113-7D MATa ura3Δ::loxP his3Δ pdc6Δ pdc1Δ::P[PDC1]-DHAD|ilvD_Sm-PDC1tpdc5Δ::P[PDC5]-ADH|sadB_Ax-PDC5t gpd2Δ::loxP fra2Δ adh1Δ::UAS(PGK1)P[FBA1]-kivD_LI(y)-ADH1t and designated as PNY1507 (BP1201). PNY1507 was transformed with isobutanol pathway plasmids pYZ090 (SEQ ID NO:195) and pBP915 (SEQ ID NO: 182) and the resultant strain was named PNY1513.

Construction of the pRS316-UAS(PGK1)-FBA1p-GUS Vector

To clone a cassette UAS(PGK1)-FBA1p (SEQ ID NO:766, first a 602 bp FBA1 promoter (FBA1p) was PCR-amplified from genomic DNA of CEN.PK with primers T-FBA1(SalI) (SEQ ID NO:767) and B-FBA1(SpeI) (SEQ ID NO:768), and cloned into SalI and SpeI sites on the plasmid pWS358-PGK1p-GUS (SEQ ID NO:769) after the PGK1p promoter was removed with a SalI/SpeI digest of the plasmid, yielding pWS358-FBA1p-GUS. The pWS358-PGK1p-GUS plasmid was generated by inserting a PGK1p and beta-glucuronidase gene (GUS) DNA fragments into multiple cloning site of pWS358, which was derived from pRS423 vector (Christianson et al., Gene, 110:119-122, 1992). Secondly, the resulting pWS358-FBA1p-GUS plasmid was digested with SalI and SacI, a DNA fragment containing a FBA1p promoter, GUS gene, and FBAt terminator gel-purified, and cloned into SalI/SacI sites on pRS316 to create pRS316-FBA1p-GUS. Thirdly, a 118 bp DNA fragment containing an upstream activation sequence (UAS) located between positions −519 and −402 upstream of the 3-phosphoglycerate kinase (PGK1) open reading frame, namely UAS(PGK1), was PCR-amplified from genomic DNA of CEN.PK with primers T-U/PGK1 (KpnI) (SEQ ID NO:770) and B-U/PGK1(SalI) (SEQ ID NO:771). The PCR product was digested with KpnI and SalI and cloned into KpnI/SalI sites on pRS316-FBA1p-GUS to create pRS316-UAS(PGK1)-FBA1p-GUS.

Example 9

Improved Recombinant Host Cells Comprising Elimination of ALD6

The purpose of this example is to describe methods to modify a yeast host strain for improved production of isobutanol. These modifications include integration of genes encoding isobutyraldehyde reductase activity and elimination of the native genes ALD6 and YMR226c, encoding NADP+-dependent acetaldehyde dehydrogenase and a NADPH-dependent dehydrogenase, respectively.

Construction of S. Cerevisiae Strain PNY2211

PNY2211 was constructed in several steps from S. cerevisiae strain PNY1507 (Example 8) as described in the following paragraphs. First PNY1507 was modified to contain a phosophoketolase gene. Next, an acetolactate synthase gene (alsS) was added to the strain, using an integration vector targeted to sequences adjacent to the phosphoketolase gene. Finally, homologous recombination was used to remove the phosphoketolase gene and integration vector sequences, resulting in a starless insertion of alsS in the intergenic region between pdc1Δ::ilvD (described in Example 12) and the native TRX1 gene of chromosome XII. The resulting genotype of PNY2211 is MATa ura3Δ:loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH| sadB_Ax-PDC5t gpd2Δ::loxP fra2Δ adh1Δ::UAS(PGK1)P[FBA1]-kivD_LI(y)-ADH1t.

A phosphoketolase gene cassette was introduced into PNY1507 by homologous recombination. The integration construct was generated as follows. The plasmid pRS423::CUP1-alsS+FBA-budA (previously described in US2009/0305363, which is herein incorporated by reference in its entirety) was digested with NotI and XmaI to remove the 1.8 kb FBA-budA sequence, and the vector was religated after treatment with Klenow fragment. Next, the CUP1 promoter was replaced with a TEF1 promoter variant (M4 variant previously described by Nevoigt et al. Appl. Environ. Microbiol. 72: 5266-5273 (2006), which is herein incorporated by reference in its entirety) via DNA synthesis and vector construction service from DNA2.0 (Menlo Park, Calif.). The resulting plasmid, pRS423::TEF(M4)-alsS was cut with StuI and MluI (removes 1.6 kb portion containing part of the alsS gene and CYC1 terminator), combined with the 4 kb PCR product generated from pRS426::GPD-xpk1+ADH-eutD (SEQ ID NO:383) with primers N1176 (SEQ ID NO:282) and N1177 (SEQ ID NO:283) and an 0.8 kb PCR product DNA (SEQ ID NO: 284) generated from yeast genomic DNA (ENO1 promoter region) with primers N822 (SEQ ID NO:285) and N1178 (SEQ ID NO:286) and transformed into S. cerevisiae strain BY4741 (ATCC #201388); gap repair cloning methodology, see Ma et al. Gene 58:201-216 (1987). Transformants were obtained by plating cells on synthetic complete medium without histidine. Proper assembly of the expected plasmid (pRS423::TEF(M4)-xpk1+ENO1-eutD, SEQ ID NO:293) was confirmed by PCR (primers N821 (SEQ ID NO:287) and N1115 (SEQ ID NO:288)) and by restriction digest (BglI).

Two clones were subsequently sequenced. The 3.1 kb TEF (M4)-xpk1 gene was isolated by digestion with SacI and NotI and cloned into the pUC19-URA3::ilvD-TRX1 vector (Clone A, cut with MlI). Cloning fragments were treated with Klenow fragment to generate blunt ends for ligation. Ligation reactions were transformed into E. coli StbI3 cells, selecting for ampicillin resistance. Insertion of TEF(M4)-xpk1 was confirmed by PCR (primers N1110 (SEQ ID NO:367) and N1114 (SEQ ID NO:290)). The vector was linearized with AflII and treated with Klenow fragment. The 1.8 kb KpnI-HincII geneticin resistance cassette (SEQ ID NO: 384) was cloned by ligation after Klenow fragment treatment. Ligation reactions were transformed into E. coli StbI3 cells, selecting for ampicillin resistance. Insertion of the geneticin cassette was confirmed by PCR (primers N160SeqF5 (SEQ ID NO:210) and BK468 (SEQ ID NO:368)). The plasmid sequence is provided as SEQ ID NO: 291 (pUC19-URA3:: pdc1::TEF(M4)-xpk1::kan).

The resulting integration cassette (pdc1::TEF(M4)-xpk1:: KanMX::TRX1) was isolated (AscI and NaeI digestion generated a 5.3 kb band that was gel purified) and transformed into PNY1507 using the Zymo Research Frozen-EZ Yeast Transformation Kit (Cat. No. T2001). Transformants were selected by plating on YPE plus 50 µg/ml G418. Integration at the expected locus was confirmed by PCR (primers N886 (SEQ ID NO:211) and N1214 (SEQ ID NO:281)). Next, plasmid pRS423::GAL1p-Cre (SEQ ID NO:271), encoding Cre recombinase, was used to remove the loxP-flanked KanMX cassette. Proper removal of the cassette was confirmed by PCR (primers oBP512 (SEQ ID NO: 337) and N160SeqF5 (SEQ ID NO:210)). Finally, the alsS integration plasmid described in Example 13, pUC19-kan::pdc1::FBA-alsS::TRX1, clone A) was transformed into this strain using the included geneticin selection marker. Two integrants were tested for acetolactate synthase activity by transformation with plasmids pYZ090ΔalsS (SEQ ID NO:371) and pBP915 (SEQ ID NO:182) (transformed using Protocol #2 in Amberg, Burke and Strathern "Methods in Yeast Genetics" (2005)), and evaluation of growth and isobutanol production in glucose-containing media (methods for growth and isobutanol measurement are as follows: All strains were grown in synthetic complete medium, minus histidine and uracil containing 0.3% glucose and 0.3% ethanol as carbon sources (10 mL medium in 125 mL vented Erlenmeyer flasks (VWR Cat. No, 89095-260). After overnight incubation (30° C., 250 rpm in an Innova®40 New Brunswick Scientific Shaker), cultures were diluted back to 0.2 OD (Eppendorf BioPhotometer measurement) in synthetic complete medium containing 2% glucose and 0.05% ethanol (20 ml medium in 125 mL tightly-capped Erlenmeyer flasks (VWR Cat. No. 89095-260)). After 48 hours incubation (30° C., 250 rpm in an Innova®40 New Brunswick Scientific Shaker), culture supernatants (collected using Spin-X centrifuge tube filter units, Costar Cat. No. 8169) were analyzed by HPLC per methods described in U.S. Appl. Pub. No. 2007/0092957, which is herein incorporated by reference in its entirety) One of the two clones was positive and was named PNY2218.

PNY2218 was treated with Cre recombinase and the resulting clones were screened for loss of the xpk1 gene and pUC19 integration vector sequences by PCR (primers N886 (SEQ ID NO: 211) and N160SeqR5 (SEQ ID NO: 388)). This left only the alsS gene integrated in the pdc1-TRX1 intergenic region after recombination the DNA upstream of xpk1 and the homologous DNA introduced during insertion of the integration vector (a "scarless" insertion since vector, marker gene and loxP sequences are lost). Although this recombination could have occurred at any point, the vector integration appeared to be stable even without geneticin selection and the recombination event was only observed after introduction of the Cre recombinase. One clone was designated PNY2211.

An isolate of PNY2218 containing the plasmids pYZ090ΔalsS and pBP915 was designated PNY2209.

PNY1528 (hADH Integrations in PNY2211)

Deletions/integrations were created by homologous recombination with PCR products containing regions of homology upstream and downstream of the target region and the URA3 gene for selection of transformants. The URA3 gene was removed by homologous recombination to create a scarless deletion/integration.

YPRCΔ15 Deletion and Horse Liver Adh Integration

The YPRCΔ15 locus was deleted and replaced with the horse liver adh gene, codon optimized for expression in Saccharomyces cerevisiae, along with the PDC5 promoter region (538 bp) from Saccharomyces cerevisiae and the ADH1 terminator region (316 bp) from Saccharomyces cerevisiae. The scarless cassette for the YPRCΔ15 deletion-P[PDC5]-adh_HL(y)-ADH1t integration was first cloned into plasmid pUC19-URA3MCS (described in Example 8).

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). YPRCΔ15 Fragment A was amplified from genomic DNA with primer oBP622 (SEQ ID NO: 212), containing a KpnI restriction site, and primer oBP623 (SEQ ID NO: 213), containing a 5' tail with homology to the 5' end of YPRCΔ15 Fragment B. YPRCΔ15 Fragment B was amplified from genomic DNA with primer oBP624 (SEQ ID NO: 214), containing a 5' tail with homology to the 3' end of YPRCΔ15 Fragment A, and primer oBP625 (SEQ ID NO: 215), containing a FseI restriction site. PCR products were purified with a PCR Purification kit (Qiagen). YPRCΔ15 Fragment A-YPRCΔ15 Fragment B was created by overlapping PCR by mixing the YPRCΔ15 Fragment A and YPRCΔ15 Fragment B PCR products and amplifying with primers oBP622 (SEQ ID NO: 212) and oBP625 (SEQ ID NO: 215). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 216), containing a Not restriction site, and primer oBP627 (SEQ ID NO: 217), containing a PacI restriction site. The YPRCΔ15 Fragment C PCR product was digested with NotI and PacI and ligated with T4 DNA ligase into the corresponding sites of the plasmid containing YPRCΔ15 Fragments AB. The PDC5 promoter region was amplified from CEN.PK 113-7D genomic DNA with primer HY21 (SEQ ID NO: 218), containing an AscI restriction site, and primer HY24 (SEQ ID NO: 219), containing a 5' tail with homology to the 5' end of adh_HI(y). adh_HI(y)-ADH1t was amplified from pBP915 (SEQ ID NO: 182) with primers HY25 (SEQ ID NO: 220), containing a 5' tail with homology to the 3' end of P[PDC5], and HY4 (SEQ ID NO: 221), containing a PmeI restriction site. PCR products were purified with a PCR Purification kit (Qiagen). P[PDC5]-adh_HL(y)-ADH1t was created by overlapping PCR by mixing the P[PDC5] and adh_HL(y)-ADH1t PCR products and amplifying with primers HY21 (SEQ ID NO: 218) and HY4 (SEQ ID NO: 221). The resulting PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 212) and oBP627 (SEQ ID NO: 217).

Competent cells of PNY2211 were made and transformed with the YPRCΔ15 deletion-P[PDC5]-adh_HL(y)-ADH1t integration cassette PCR product using a Frozen-EZ Yeast Transformation II kit (Zymo Research; Orange, Calif.). Transformation mixtures were plated on synthetic complete media lacking uracil supplemented with 1% ethanol at 30° C. Transformants were screened for by PCR with primers URA3-end F (SEQ ID NO: 222) and oBP637 (SEQ ID NO: 224). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of YPRCΔ15 and integration of P[PDC5]-adh_HL(y)-ADH1t were confirmed by PCR with external primers oBP636 (SEQ ID NO: 223) and oBP637 (SEQ ID NO: 224) using genomic DNA prepared with a YeaStar Genomic DNA kit (Zymo Research). A correct isolate of the following genotype was selected for further modification: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_LI(y)-ADH1t yprcΔ15Δ::P[PDC5]-ADH|adh_HI-ADH1t.

Horse Liver Adh Integration at Fra2Δ

The horse liver adh gene, codon optimized for expression in *Saccharomyces cerevisiae*, along with the PDC1 promoter region (870 bp) from *Saccharomyces cerevisiae* and the ADH1 terminator region (316 bp) from *Saccharomyces cerevisiae*, was integrated into the site of the fra2 deletion. The scarless cassette for the fra2Δ-P[PDC1]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). fra2Δ Fragment C was amplified from genomic DNA with primer oBP695 (SEQ ID NO: 229), containing a NotI restriction site, and primer oBP696 (SEQ ID NO: 230), containing a PacI restriction site. The fra2Δ Fragment C PCR product was digested with NotI and PacI and ligated with T4 DNA ligase into the corresponding sites of pUC19-URA3MCS. fra2Δ Fragment B was amplified from genomic DNA with primer oBP693 (SEQ ID NO: 227), containing a PmeI restriction site, and primer oBP694 (SEQ ID NO: 228), containing a FseI restriction site. The resulting PCR product was digested with PmeI and FseI and ligated with T4 DNA ligase into the corresponding sites of the plasmid containing fra2Δ fragment C after digestion with the appropriate enzymes. fra2Δ Fragment A was amplified from genomic DNA with primer oBP691 (SEQ ID NO: 225), containing BamHI and AsiSI restriction sites, and primer oBP692 (SEQ ID NO: 226), containing AscI and SwaI restriction sites. The fra2Δ fragment A PCR product was digested with BamHI and AscI and ligated with T4 DNA ligase into the corresponding sites of the plasmid containing fra2Δ fragments BC after digestion with the appropriate enzymes. The PDC1 promoter region was amplified from CEN.PK 113-7D genomic DNA with primer HY16 (SEQ ID NO: 231), containing an AscI restriction site, and primer HY19 (SEQ ID NO: 232), containing a 5 tail with homology to the 5' end of adh_HI(y). adh_HI(y)-ADH1t was amplified from pBP915 with primers HY20 (SEQ ID NO: 233), containing a 5' tail with homology to the 3' end of P[PDC1], and HY4 (SEQ ID NO: 221), containing a PmeI restriction site. PCR products were purified with a PCR Purification kit (Qiagen). P[PDC1]-adh_HL(y)-ADH1t was created by overlapping PCR by mixing the P[PDC1] and adh_HL(y)-ADH1t PCR products and amplifying with primers HY16 (SEQ ID NO: 231) and HY4 (SEQ ID NO: 221). The resulting PCR product was digested with AscI and PmeI and ligated with T4 DNA ligase into the corresponding sites of the plasmid containing fra2Δ Fragments ABC. The entire integration cassette was amplified from the resulting plasmid with primers oBP691 (SEQ ID NO: 225) and oBP696 (SEQ ID NO: 230).

Competent cells of the PNY2211 variant with adh_HI(y) integrated at YPRCΔ15 were made and transformed with the fra2Δ-P[PDC1]-adh_HL(y)-ADH1t integration cassette PCR product using a Frozen-EZ Yeast Transformation II kit (Zymo Research). Transformation mixtures were plated on synthetic complete media lacking uracil supplemented with 1% ethanol at 30° C. Transformants were screened for by PCR with primers URA3-end F (SEQ ID NO: 222) and oBP731 (SEQ ID NO: 235). Correct transformants were grown in YPE (1% ethanol) and plated on synthetic complete medium supplemented with 1% EtOH and containing 5-fluoro-orotic acid (0.1%) at 30° C. to select for isolates that lost the URA3 marker. The integration of P[PDC1]-adh_HL(y)-ADH1t was confirmed by colony PCR with internal primer HY31 (SEQ ID NO: 236) and external primer oBP731 (SEQ ID NO: 235) and PCR with external primers oBP730 (SEQ ID NO: 234) and oBP731 (SEQ ID NO: 235) using genomic DNA prepared with a YeaStar Genomic DNA kit (Zymo Research). A correct isolate of the following genotype was designated PNY1528: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_LI(y)-ADH1t yprcΔ15Δ::P[PDC5]-ADH|adh_HI-ADH1t.

PNY2237 (Scarless YMR226c Deletion)

The gene YMR226c was deleted from *S. cerevisiae* strain PNY1528 by homologous recombination using a PCR amplified 2.0 kb linear scarless deletion cassette. The cassette was constructed from spliced PCR amplified fragments comprised of the URA3 gene, along with its native promoter and terminator as a selectable marker, upstream and downstream homology sequences flanking the YMR226c gene chromosomal locus to promote integration of the deletion cassette and removal of the native intervening sequence and a repeat sequence to promote recombination and removal of the URA3 marker. Forward and reverse PCR primers (N1251 and N1252, SEQ ID NOs: 247 and 248, respectively), amplified a 1,208 bp URA3 expression cassette originating from pLA33 (pUC19::loxP-URA3-loxP (SEQ ID NO: 268)). Forward and reverse primers (N1253 and N1254, SEQ ID NOs: 249 and 250, respectively), amplified a 250 bp downstream homology sequence with a 3' URA3 overlap sequence tag from a genomic DNA preparation of *S. cerevisiae* strain PNY2211 (above). Forward and reverse PCR primers (N1255 and N1256, SEQ ID NOs: 251 and 252, respectively) amplified a 250 bp repeat sequence with a 5' URA3 overlap sequence tag from a genomic DNA preparation of *S. cerevisiae* strain PNY2211. Forward and reverse primers (N1257 and N1258, SEQ ID NOs: 253 and 254, respectively) amplified a 250 bp upstream homology sequence with a 5' repeat overlap sequence tag from a genomic DNA preparation of *S. cerevisiae* strain PNY2211.

Approximately 1.5 µg of the PCR amplified cassette was transformed into strain PNY1528 (above) made competent using the ZYMO Research Frozen Yeast Transformation Kit and the transformation mix plated on SE 1.0%-uracil and incubated at 30° C. for selection of cells with an integrated ymr226cΔ::URA3 cassette. Transformants appearing after 72 to 96 hours are subsequently short-streaked on the same medium and incubated at 30° C. for 24 to 48 hours. The short-streaks are screened for ymr226cΔ::URA3 by PCR, with a 5' outward facing URA3 deletion cassette-specific internal primer (N1249, SEQ ID NO: 245) paired with a flanking inward facing chromosome-specific primer (N1239, SEQ ID NO: 243) and a 3' outward-facing URA3 deletion cassette-specific primer (N1250, SEQ ID NO: 246) paired with a flanking inward-facing chromosome-specific primer (N1242, SEQ ID NO: 244). A positive PNY1528 ymr226cΔ::URA3 PCR screen resulted in 5' and 3' PCR products of 598 and 726 bp, respectively.

Three positive PNY1528 ymr226cΔ::URA3 clones were picked and cultured overnight in a YPE 1% medium of which 100 μL was plated on YPE 1%+5-FOA for marker removal. Colonies appearing after 24 to 48 hours were PCR screened for marker loss with 5' and 3' chromosome-specific primers (N1239 and N1242). A positive PNY1528 ymr226cΔ markerless PCR screen resulted in a PCR product of 801 bp. Multiple clones were obtained and one was designated PNY2237.

PNY2238 and PNY2243 (ALD6 Deletion Strains)

A vector was designed to replace the ALD6 coding sequence with a Cre-lox recyclable URA3 selection marker. Sequences 5' and 3' of ALD6 were amplified by PCR (primer pairs N1179 and N1180 and N1181 and N1182, respectively; SEQ ID NOs: 237, 238, 239, and 240, respectively). After cloning these fragments into TOPO vectors (Invitrogen Cat. No. K2875-J10) and sequencing (M13 forward (SEQ ID NO:269) and reverse (SEQ ID NO:270) primers), the 5' and 3' flanks were cloned into pLA33 (pUC19::loxP::URA3::loxP) (SEQ ID NO:268) at the EcoRI and SphI sites, respectively. Each ligation reaction was transformed into *E. coli* StbI3 cells, which were incubated on LB Amp plates to select for transformants. Proper insertion of sequences was confirmed by PCR (primers M13 forward (SEQ ID NO: 269) and N1180 (SEQ ID NO:238) and M13 reverse (SEQ ID NO:270) and N1181 (SEQ ID NO:239), respectively).

The vector described above (pUC19::ald6Δ::loxP-URA3-loxP) was linearized with AhdI and transformed into PNY1528 and PNY2237 using the standard lithium acetate method (except that incubation of cells with DNA was extended to 2.5 h). Transformants were obtained by plating on synthetic complete medium minus uracil that provided 1% ethanol as the carbon source. Patched transformants were screened by PCR to confirm the deletion/integration, using primers N1212 (SEQ ID NO: 241) and N1180 (5' end) (SEQ ID NO: 238) and N1181 (SEQ ID NO: 239) and N1213 (SEQ ID NO: 242) (3' end). A plasmid carrying Cre recombinase (pRS423::GAL1p-Cre=SEQ ID No. 271) was transformed into the strain using histidine marker selection. Transformants were passaged on YPE supplemented with 0.5% galactose. Colonies were screened for resistance to 5-FOA (loss of URA3 marker) and for histidine auxotrophy (loss of the Cre plasmid). Proper removal of the URA3 gene via the flanking loxP sites was confirmed by PCR (primers N1262 and N1263, SEQ ID NOs: 255 and 256, respectively). Additionally, primers internal to the ALD6 gene (N1230 and N1231; SEQ ID NOs: 261 and 262, respectively) were used to insure that no merodiploids were present. Finally, ald6Δ::loxP clones were screened by PCR to confirm that a translocation between ura3Δ::loxP (N1228 and N1229, SEQ ID NOs: 259 and 260) and gpd2Δ::loxP (N1223 and N1225, SEQ ID NOs: 257 and 258) had not occurred. Two positive clones were identified from screening of transformants of PNY1528. Clone B has been designated PNY2243. Three positive clones were identified from screening transformants of PNY2237. Clones E and K were both assessed for isobutanol production at small scale (below). Although statistically identical in most parameters, Clone E was selected (PNY2238) for further development.

Example 10

Isobutanol Pathway Plasmids

The purpose of this example is to describe construction or modification of isobutanol pathway plasmids for production of isobutanol in host strains.

pYZ067 (SEQ ID NO:374) was constructed to contain the following chimeric genes: 1) the coding region of the ilvD gene from *S. mutans* UA159 with a C-terminal Lumio tag expressed from the yeast FBA1 promoter followed by the FBA1 terminator for expression of dihydroxy acid dehydratase, 2) the coding region for horse liver ADH expressed from the yeast GPM1 promoter followed by the ADH1 terminator for expression of alcohol dehydrogenase, and 3) the coding region of the KivD gene from *Lactococcus lactis* expressed from the yeast TDH3 promoter followed by the TDH3 terminator for expression of ketoisovalerate decarboxylase.

pYZ067ΔkivDΔhADH (SEQ ID NO: 385) was constructed from pYZ067 (SEQ ID NO: 374) by deleting the promoter-gene-terminator cassettes for both kivD and adh. pYZ067 was digested with BamHI and SacI (New England BioLabs; Ipswich, Mass.), and the 7934 bp fragment was purified on an agarose gel followed by a Gel Extraction kit (Qiagen; Valencia, Calif.). The isolated fragment of DNA was treated with DNA Polymerase I, Large (Klenow) Fragment (New England BioLabs; Ipswich, Mass.) and then self-ligated with T4 DNA ligase and used to transform competent TOP10 *Escherichia coli* (Invitrogen; Carlsbad, Calif.). Plasmids from transformants were isolated and checked for the proper deletion by sequence analysis. A correct plasmid isolate was designated pYZ067ΔkivDΔhADH.

pYZ067ΔkivDΔilvD (SEQ ID NO: 772) was constructed to contain a chimeric gene having the coding region of the adh gene from horse liver (nt position 3148-2021), codon optimized for expression in *Saccharomyces cerevisiae*, expressed from the yeast GPM promoter (nt 3916-3160) and followed by the ADH1 terminator (nt 2012-1697) for expression of ADH. pYZ067DkivDDilvD was constructed from pYZ067 by deleting the promoter-gene-terminator cassettes for both kivD and ilvD. pYZ067 was digested with AatII and SacI (New England BioLabs; Ipswich, Mass.) and the 10196 bp fragment was purified on an agarose gel followed by a Gel Extraction kit (Qiagen; Valencia, Calif.). The isolated fragment of DNA was treated with DNA Polymerase I, Large (Klenow) Fragment (New England BioLabs; Ipswich, Mass.) and then self-ligated with T4 DNA ligase. The resulting plasmid was then digested with NgoMIV and BamHI (New England BioLabs; Ipswich, Mass.) and the 7533 bp fragment was purified on an agarose gel followed by a Gel Extraction kit (Qiagen; Valencia, Calif.). The isolated fragment of DNA was treated with DNA Polymerase I, Large (Klenow) Fragment (New England BioLabs; Ipswich, Mass.) and then self-ligated with T4 DNA ligase. Plasmids were isolated and checked for the proper deletions by sequence analysis. A correct plasmid isolate was designated pYZ067DkivDDilvD.

pK9G9.OLE1p.ilvD (SEQ ID NO: 773), derived from pYZ090 (SEQ ID NO: 195), was constructed to contain a chimeric gene having the coding region of the ilvD gene from *Streptococcus mutans* (nt position 5377-3641) expressed from the yeast OLE1 promoter (nt 5986-5387) and followed by the FBA1 terminator (nt 3632-3320) for expression of DHAD, and a chimeric gene having the coding region of the variant K9G9 of the ilvC gene from *Anaerostipes caccae* (nucleic acid and amino acid SEQ ID NOs: 774 and 647) (nt 1628-2659) expressed from the yeast ILV5 promoter (nt 427-1620) and followed by the ILV5 terminator (nt 2685-3307) for expression of KARI. Construction of the plasmid was as follows. The chimeric gene from plasmid pYZ067 having the coding region of the ilvD gene from *Streptococcus mutans* expressed from the yeast FBA1 promoter and followed by the FBA1 terminator was ligated into pYZ090 after digestion with restriction enzymes NgoMIV and BamHI. The alsS coding region and 280 bp from the 3' end of the CUP1 promoter was deleted from the resulting plasmid by digesting with the restriction enzymes SpeI and PacI and self-ligating the resulting large DNA fragment. The yeast FBA1 promoter upstream of ilvD was removed from the resulting plasmid by digesting with the restriction enzymes NgoMIV and PmII and was replaced with the yeast OLE1 promoter amplified with primers pOLE1-NgoMI (SEQ ID NO: 775) and pOLE1-PmII (SEQ ID NO: 776). The coding region of the ilvC gene from *Lactococcus lactis* was deleted from the resulting plasmid by digestion with restriction enzymes PmeI and SfiI followed by gel purification of the large DNA fragment. The coding region of the variant K9G9 ilvC gene (SEQ ID NO: 777) from *Anaerostipes caccae* was digested out of pLH701 (SEQ ID NO: 778) with PmeI and SfiI and gel purified. The two DNA fragments were ligated to generate pK9G9.OLE1p.ilvD.

Example 11

Construction of PNY2240 and PNY2242

Strain PNY2240 was derived from PNY2211 after transformation with plasmids pLH702 (SEQ ID NO: 181) and pBP915 (SEQ ID NO: 182). Transformants were plated on synthetic complete medium without histidine or uracil (1% ethanol as carbon source). Transformants were patched to the same medium containing, instead, 2% glucose and 0.05% ethanol as carbon sources. Three patches were used to inoculate liquid medium (synthetic complete minus uracil with 0.3% glucose and 0.3% ethanol as carbon sources). To test isobutanol production, liquid cultures were sub-cultured into synthetic complete medium minus uracil containing 2% glucose and 0.05% ethanol as carbon sources that also contained BME vitamin mix (Sigma Cat. No. B6891). Cultures were incubated in sealed serum vials (10 ml medium in 15 ml vials) at 30° C. with shaking (250 rpm in an Infors Multitron shaker). After 48 hours, culture medium was filtered (Spin-X column) and analyzed by HPLC (as described in US App. Pub. No. 2007/0092957, which is incorporated herein by reference in its entirety). One clone was designated PNY2240.

Strain PNY2242 was derived from PNY2238 after transformation with plasmids pLH702 (SEQ ID NO: 181) and pYZ067ΔkivDΔhADH (described herein above). Transformants were plated on synthetic complete medium without histidine or uracil (1% ethanol as carbon source). Transformants were patched to the same medium containing, instead, 2% glucose and 0.05% ethanol as carbon sources. Three patches were tested for isobutanol production, as described above. All three performed similarly in terms of glucose consumption and isobutanol production. One clone was designated PNY2242 and was further characterized under fermentation conditions, as described herein below.

Example 12

Construction of *Saccharomyces cerevisiae* Strain BP1064 (PNY1503)

The strain BP1064 was derived from CEN.PK 113-7D (CBS 8340; Centraalbureau voor Schimmelcultures (CBS) Fungal Biodiversity Centre, Netherlands) and contains deletions of the following genes: URA3, HIS3, PDC1, PDC5, PDC6, and GPD2. BP1064 was transformed with plasmids pYZ090 (SEQ ID NO:195) and pLH468 (SEQ ID NO:139) to create strain NGCI-070 (BP1083; PNY1504).

Deletions, which completely removed the entire coding sequence, were created by homologous recombination with PCR fragments containing regions of homology upstream and downstream of the target gene and either a G418 resistance marker or URA3 gene for selection of transformants. The G418 resistance marker, flanked by loxP sites, was removed using Cre recombinase (pRS423::PGAL1-cre; SEQ ID NO: 271). The URA3 gene was removed by homologous recombination to create a scarless deletion, or if flanked by loxP sites was removed using Cre recombinase.

URA3 Deletion

To delete the endogenous URA3 coding region, a ura3::loxP-kanMX-loxP cassette was PCR-amplified from pLA54 template DNA (SEQ ID NO:386). pLA54 contains the *K. lactis* TEF1 promoter and kanMX marker, and is flanked by loxP sites to allow recombination with Cre recombinase and removal of the marker. PCR was done using Phusion DNA polymerase and primers BK505 and BK506 (SEQ ID NOs: 294 and 295). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G418 (100 μg/ml) at 30° C. Transformants were screened to verify correct integration by PCR using primers LA468 and LA492 (SEQ ID NOs:296 and 297) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO:298) and primer oBP453 (SEQ ID NO:299), containing a 5' tail with homology to the 5' end of HIS3 Fragment B. HIS3 Fragment B was amplified with primer oBP454 (SEQ ID NO:300), containing a 5' tail with homology to the 3' end of HIS3 Fragment A, and primer oBP455 (SEQ ID NO:301), containing a 5' tail with homology to the 5' end of HIS3 Fragment U. HIS3 Fragment U was amplified with primer oBP456 (SEQ ID NO:302), containing a 5" tail with homology to the 3' end of HIS3 Fragment B, and primer oBP457 (SEQ ID NO:303), containing a 5' tail with homology to the 5' end of HIS3 Fragment C. HIS3 Fragment C was amplified with primer oBP458 (SEQ ID NO:304), containing a 5' tail with homology to the 3' end of HIS3 Fragment U, and primer oBP459 (SEQ ID NO:305). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO:298) and oBP455 (SEQ ID NO:301). HIS3 Fragment UC was created by overlapping PCR by mixing HIS3 Fragment U and HIS3 Fragment C and amplifying with primers oBP456 (SEQ ID NO:302) and oBP459 (SEQ ID NO:305). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO:298) and oBP459 (SEQ ID NO:305). The PCR product was purified with a PCR Purification kit (Qiagen).

Competent cells of CEN.PK 113-7D Δura3::kanMX were made and transformed with the HIS3 ABUC PCR cassette using a Frozen-EZ Yeast Transformation II kit (Zymo Research; Orange, Calif.). Transformation mixtures were plated on synthetic complete media lacking uracil supplemented with 2% glucose at 30° C. Transformants with a his3 knockout were screened for by PCR with primers oBP460 (SEQ ID NO:306) and oBP461 (SEQ ID NO:307) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the ΔUra3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 271,) using a Frozen-EZ Yeast Transformation II kit (Zymo Research) and plating on synthetic complete medium lacking histidine and uracil supplemented with 2% glucose at 30° C. Transformants were grown in YP supplemented with 1% galactose at 30° C. for ~6 hours to induce the Cre recombinase and KanMX marker excision and plated onto YPD (2% glucose) plates at 30° C. for recovery. An isolate was grown overnight in YPD and plated on synthetic complete medium containing 5-fluoro-orotic acid (0.1%) at 30° C. to select for isolates that lost the URA3 marker, 5-FOA resistant isolates were grown in and plated on YPD for removal of the pRS423::PGAL1-cre plasmid, Isolates were checked for loss of the KanMX marker, URA3 marker, and pRS423::PGAL1-cre plasmid by assaying growth on YPD+G418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO:308) and oBP451 (SEQ ID NO:309) for Δura3 and primers oBP460 (SEQ ID NO:306) and oBP461 (SEQ ID NO:307) for Δhis3 using genomic DNA prepared with a Gentra Puregene Yeast/Bact kit (Qiagen).

PDC6 Deletion

The four fragments for the PCR cassette for the scarless PDC6 deletion were amplified using Phusion High Fidelity PCR Master Mix (New England BioLabs) and CEN.PK 113-7D genomic DNA as template, prepared with a Gentra Puregene Yeast/Bact kit (Qiagen). PDC6 Fragment A was amplified with primer oBP440 (SEQ ID NO:310) and primer oBP441 (SEQ ID NO:311), containing a 5' tail with homology to the 5' end of PDC6 Fragment B. PDC6 Fragment B was amplified with primer oBP442 (SEQ ID NO:312), containing a 5' tail with homology to the 3" end of PDC6 Fragment A, and primer oBP443 (SEQ ID NO:313), containing a 5' tail with homology to the 5' end of PDC6 Fragment U. PDC6 Fragment U was amplified with primer oBP444 (SEQ ID NO:314), containing a 5' tail with homology to the 3' end of PDC6 Fragment B, and primer oBP445 (SEQ ID NO:315), containing a 5' tail with homology to the 5' end of PDC6 Fragment C. PDC6 Fragment C was amplified with primer oBP446 (SEQ ID NO:316), containing a 5' tail with homology to the 3' end of PDC6 Fragment U, and primer oBP447 (SEQ ID NO:317). PCR products were purified with a PCR Purification kit (Qiagen), PDC6 Fragment AB was created by overlapping PCR by mixing PDC6 Fragment A and PDC6 Fragment B and amplifying with primers oBP440 (SEQ ID NO:310) and oBP443 (SEQ ID NO:313), PDC6 Fragment UC was created by overlapping PCR by mixing PDC6 Fragment U and PDC6 Fragment C and amplifying with primers oBP444 (SEQ ID NO:314) and oBP447 (SEQ ID NO:317). The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO:310) and oBP447 (SEQ ID NO:317). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30° C. Transformants with a pdc6 knockout were screened for by PCR with primers oBP448 (SEQ ID NO:318) and oBP449 (SEQ ID NO:319) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO:318) and oBP449 (SEQ ID NO:319) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO:320) and oBP555 (SEQ ID NO:321). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from *Streptococcus mutans* ATCC #700610. The A fragment followed by the ilvD coding region from *Streptococcus mutans* for the PCR cassette for the PDC1 deletion-ilvDSm integration was amplified using Phusion High Fidelity PCR Master Mix (New England BioLabs) and NYLA83 genomic DNA as template, prepared with a Gentra Puregene Yeast/Bact kit (Qiagen). NYLA83 is a strain which carries the PDC1 deletion-ilvDSm integration described in U.S. Patent Application Publication No. 2009/0305363, which is herein incorporated by reference in its entirety. PDC1 Fragment A-ilvDSm (SEQ ID NO:322) was amplified with primer oBP513 (SEQ ID NO:326) and primer oBP515 (SEQ ID NO:327), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO:328) containing a 5' tail with homology to the 3' end of PDC1 Fragment A-ilvDSm, and primer oBP517 (SEQ ID NO:329), containing a 5' tail with homology to the 5' end of PDC1 Fragment U. PDC1 Fragment U was amplified with primer oBP518 (SEQ ID NO:330), containing a 5' tail with homology to the 3' end of PDC1 Fragment B, and primer oBP519 (SEQ ID NO:331), containing a 5' tail with homology to the 5' end of PDC1 Fragment C. PDC1 Fragment C was amplified with primer oBP520 (SEQ ID NO:332), containing a 5' tail with homology to the 3' end of PDC1 Fragment U, and primer oBP521 (SEQ ID NO:333). PCR products were purified with a PCR Purification kit (Qiagen). PDC1 Fragment A-ilvDSm-B was created by overlapping PCR by mixing PDC1 Fragment A-ilvDSm and PDC1 Fragment B and amplifying with primers oBP513 (SEQ ID NO:326) and oBP517 (SEQ ID NO:329). PDC1 Fragment UC was created by overlapping PCR by mixing PDC1 Fragment U and PDC1 Fragment C and amplifying with primers oBP518 (SEQ ID NO:330) and oBP521 (SEQ ID NO:333). The resulting PCR products were purified on an agarose gel followed by a Gel Extraction kit (Qiagen). The PDC1 A-ilvDSm-BUG cassette (SEQ ID NO:323) was created by overlapping PCR by mixing PDC1 Fragment A-ilvDSm-B and PDC1 Fragment UC and amplifying with primers oBP513 (SEQ ID NO:326) and oBP521 (SEQ ID NO:333). The PCR product was purified with a PCR Purification kit (Qiagen).

Competent cells of CEN.PK 113-7D Δura3:loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30° C. Transformants with a pdc1 knockout ilvDSm integration were screened for by PCR with primers oBP511 (SEQ ID NO:336) and oBP512 (SEQ ID NO:337) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO:338) and oBP551 (SEQ ID NO:339). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30° C. to select for isolates that lost the URA3 marker. The deletion of PDC1, integration of ilvDSm, and marker removal were confirmed by PCR and sequencing with primers oBP511 (SEQ ID NO:336) and oBP512 (SEQ ID NO:337) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm and designated as BP907.

PDC5 Deletion sadB Integration

The PDC5 gene was deleted and replaced with the sadB coding region from *Achromobacter xylosoxidans* (the sadB gene is described in U.S. Patent Appl. No. 2009/0269823, which is herein incorporated by reference in its entirety). A segment of the PCR cassette for the PDC5 deletion-sadB integration was first cloned into plasmid pUC19-URA3MCS.

pUC19-URA3MCS is pUC19 based and contains the sequence of the URA3 gene from *Saccharomyces cerevisiae* situated within a multiple cloning site (MCS). pUC19 contains the pMB1 replicon and a gene coding for beta-lactamase for replication and selection in *Escherichia coli*. In addition to the coding sequence for URA3, the sequences from upstream and downstream of this gene were included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccharomyces cerevisiae* CEN.PK 113-7D genomic DNA was amplified with primers oBP438 (SEQ ID NO:334), containing BamHI, AscI, PmeI, and FseI restriction sites, and oBP439 (SEQ ID NO:335), containing XbaI, PacI, and NotI restriction sites, using Phusion High-Fidelity PCR Master Mix (New England BioLabs). Genomic DNA was prepared using a Gentra Puregene Yeast/Bact kit (Qiagen). The PCR product and pUC19 (SEQ ID NO:325) were ligated with T4 DNA ligase after digestion with BamHI and XbaI to create vector pUC19-URA3MCS. The vector was confirmed by PCR and sequencing with primers oBP264 (SEQ ID NO:342) and oBP265 (SEQ ID NO:343).

The coding sequence of sadB and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO:359) as template with primer oBP530 (SEQ ID NO:344), containing an AscI restriction site, and primer oBP531 (SEQ ID NO:345), containing a 5' tail with homology to the 5' end of PDC5 Fragment B. PDC5 Fragment B was amplified with primer oBP532 (SEQ ID NO:346), containing a 5" tail with homology to the 3' end of sadB, and primer oBP533 (SEQ ID NO:347), containing a PmeI restriction site. PCR products were purified with a PCR Purification kit (Qiagen), sadB-PDC5 Fragment B was created by overlapping PCR by mixing the sadB and PDC5 Fragment B PCR products and amplifying with primers oBP536 (SEQ ID NO:344) and oBP533 (SEQ ID NO:347). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO:348) and oBP546 (SEQ ID NO:349), containing a 5' tail with homology to the 5' end of PDC5 Fragment C. PDC5 Fragment C was amplified with primer oBP547 (SEQ ID NO:350) containing a 5' tail with homology to the 3' end of PDC5 sadB-Fragment B-Fragment U, and primer oBP539 (SEQ ID NO:351). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO:348) and oBP539 (SEQ ID NO:351). The resulting PCR product was purified on an agarose gel followed by a Gel Extraction kit (Qiagen). The PDC5 A-sadB-BUC cassette (SEQ ID NO:324) was created by amplifying PDC5 sadB-Fragment B-Fragment U-Fragment C with primers oBP542 (SEQ ID NO:352), containing a 5' tail with homology to the 50 nucleotides immediately upstream of the native PDC5 coding sequence, and oBP539 (SEQ ID NO:351). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30 C. Transformants with a pdc5 knockout sadB integration were screened for by PCR with primers oBP540 (SEQ ID NO:353) and oBP541 (SEQ ID NO:354) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO:355) and oBP553 (SEQ ID NO:356). A correct transformant was selected as strain CEN.PK 113-7D Δura3::loxP Δhis3 Δpdc6 Δpdc1::ilvDSm Δpdc5::sadB-URA3.

CEN.PK 113-7D Δura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30 C to select for isolates that lost the URA3 marker. The deletion of PDC5, integration of sadB, and marker removal were confirmed by PCR with primers oBP540 (SEQ ID NO:353) and oBP541 (SEQ ID NO:354) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

GPD2 Deletion

To delete the endogenous GPD2 coding region, a gpd2::loxP-URA3-loxP cassette (SEQ ID NO:361) was PCR-amplified using loxP-URA3-loxP PCR (SEQ ID NO:360) as template DNA. loxP-URA3-loxP contains the URA3 marker from (ATCC #77107) flanked by loxP recombinase sites. PCR was done using Phusion DNA polymerase and primers LA512 and LA513 (SEQ ID NOs:340 and 341). The GPD2 portion of each primer was derived from the 5' region upstream of the GPD2 coding region and 3' region downstream of the coding region such that integration of the loxP-URA3-loxP marker resulted in replacement of the GPD2 coding region. The PCR product was transformed into BP913 and transformants were selected on synthetic complete media lacking uracil supplemented with 1% ethanol (no glucose). Transformants were screened to verify correct integration by PCR using primers oBP582 and AA270 (SEQ ID NOs:357 and 358).

The URA3 marker was recycled by transformation with pRS423::PGAL1-cre (SEQ ID NO:271) and plating on synthetic complete media lacking histidine supplemented with 1% ethanol at 30 C. Transformants were streaked on synthetic complete medium supplemented with 1% ethanol and containing 5-fluoro-orotic acid (0.1%) and incubated at 300 to select for isolates that lost the URA3 marker. 5-FOA resistant isolates were grown in YPE (1% ethanol) for removal of the pRS423::PGAL1-cre plasmid. The deletion and marker removal were confirmed by PCR with primers oBP582 (SEQ ID NO:357) and oBP591 (SEQ ID NO:362). The correct isolate was selected as strain CEN.PK 113-7D Δura3::loxP Δhis3 Δpdc6 Δpdc1::ilvDSm Δpdc5::sadB Δgpd2::loxP and designated as BP1064 (PNY1503).

Example 13

Construction of PNY2204 and Isobutanol Pathway Plasmids

The purpose of this example is to describe construction of a vector to enable integration of a gene encoding acetolactate synthase into the naturally occurring intergenic region between the PDC1 and TRX1 coding sequences in Chromosome XII. Strains resulting from the use of this vector are also described.

Construction of Integration Vector pUC19-kan::pdc1::FBA-alsS::TRX1

The FBA-alsS-CYCt cassette was constructed by moving the 1.7 kb BbvCI/PacI fragment from pRS426::GPD::alsS::CYC (described in U.S. Pat. No. 7,851,188, which is herein incorporated by reference in its entirety) to pRS426::FBA::ILV5::CYC (described in U.S. Pat. No. 7,851,188, which is herein incorporated by reference in its entirety), which had been previously digested with BbvCI/PacI to release the ILV5 gene. Ligation reactions were transformed into E. coli TOP10 cells and transformants were screened by PCR using primers N98SeqF1 (SEQ ID NO:363) and N99SeqR2 (SEQ ID NO:365). The FBA-alsS-CYCt cassette was isolated from the vector using BglII and NotI for cloning into pUC19-URA3::ilvD-TRX1 (done "B") at the AflII site (Klenow fragment was used to make ends compatible for ligation). Transformants containing the alsS cassette in both orientations in the vector were obtained and confirmed by PCR using primers N98SeqF4 (SEQ ID NO:364) and N1111 (SEQ ID NO:366) for configuration "A" and N98SeqF4 (SEQ ID NO:364) and N1110 (SEQ ID NO:367) for configuration "B". A geneticin selectable version of the "A" configuration vector was then made by removing the URA3 gene (1.2 kb NotI/NaeI fragment) and adding a geneticin cassette. Klenow fragment was used to make all ends compatible for ligation, and transformants were screened by PCR to select a clone with the geneticin resistance gene in the same orientation as the previous URA3 marker using primers BK468 (SEQ ID NO:368) and N160SeqF5 (SEQ ID NO:210). The resulting clone was called pUC19-kan::pdc1::FBA-alsS::TRX1 (clone A) (SEQ ID NO:387).

Construction of alsS Integrant Strains and Isobutanol-Producing Derivatives

The pUC19-kan::pdc1::FBA-alsS integration vector described above was linearized with PmeI and transformed into PNY1507 (Example 8). PmeI cuts the vector within the cloned pdc1-TRX1 intergenic region and thus leads to targeted integration at that location (Rodney Rothstein, Methods in Enzymology, 1991, volume 194, pp. 281-301). Transformants were selected on YPE plus 50 μg/ml G418. Patched transformants were screened by PCR for the integration event using primers N160SeqF5 (SEQ ID NO:210) and oBP512 (SEQ ID NO:337). Two transformants were tested indirectly for acetolactate synthase function by evaluating the strains ability to make isobutanol. To do this, additional isobutanol pathway genes were supplied on E. coli-yeast shuttle vectors (pYZ090ΔalsS and pBP915, described below). One done was designated as PNY2205. The plasmid-free parent strain was designated PNY2204 (MATa ura3Δ::loxP his3Δ pdc6Δ pdc1::P[PDC1]-DHAD|ilvD_Sm-PDC1t-pUC19-loxP-kanMX-loxP-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_LI(y)-ADH1t).

Isobutanol Pathway Plasmids (pYZ090ΔalsS and pBP915)

pYZ090 (SEQ ID NO:195) was digested with SpeI and NotI to remove most of the CUP1 promoter and all of the alsS coding sequence and CYC terminator. The vector was then self-ligated after treatment with Klenow fragment and transformed into E. coli StbI3 cells, selecting for ampicillin resistance. Removal of the DNA region was confirmed for two independent clones by DNA sequencing across the ligation junction by PCR using primer N191 (SEQ ID NO:370). The resulting plasmid was named pYZ090ΔalsS (SEQ ID NO:371). The pLH468 plasmid was constructed for expression of DHAD, KivD and HADH in yeast. pBP915 (SEQ ID NO: 182) was constructed from pLH468 (SEQ ID NO:139) by deleting the kivD gene and 957 base pairs of the TDH3 promoter upstream of kivD. pLH468 was digested with SwaI and the large fragment (12896 bp) was purified on an agarose gel followed by a Gel Extraction kit (Qiagen; Valencia, Calif.). The isolated fragment of DNA was self-ligated with T4 DNA ligase and used to transform electrocompetent TOP10 *Escherichia coli* (Invitrogen; Carlsbad, Calif.). Plasmids from transformants were isolated and checked for the proper deletion by restriction analysis with the SwaI restriction enzyme. Isolates were also sequenced across the deletion site with primers oBP556 (SEQ ID NO:372) and oBP561 (SEQ ID NO:373). A clone with the proper deletion was designated pBP915 (pLH468ΔkivD) (SEQ ID NO:182).

pYZ090 is based on the pHR81 (ATCC #87541. Manassas, Va.) backbone. pYZ090 was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI.

Example 14

Isobutanol Production-PNY1910 and PNY2242

Methods:
Preparation of Inoculum Medium

1 L of inoculum medium contained: 6.7 g, Yeast Nitrogen Base w/o amino acids (Difco 0919-15-3); 2.8 g, Yeast Synthetic Drop-out Medium Supplement Without Histidine, Leucine, Tryptophan and Uracil (Sigma Y2001); 20 mL of 1% (w/v) L-Leucine; 4 mL of 1% (w/v) L-Tryptophan; 3 g of ethanol; 10 g of glucose.

Preparation of Defined Fermentation Medium

The volume of broth after inoculation was 800 mL, with the following final composition, per liter: 5 g ammonium sulfate, 2.8 g potassium phosphate monobasic, 1.9 g magnesium sulfate septahydrate, 0.2 mL antifoam (Sigma DF204), Yeast Synthetic Drop-out Medium Supplement without Histidine, Leucine, Tryptophan, and Uracil (Sigma Y2001), 16 mg L-leucine, 4 mg L-tryptophan, 6 mL of a vitamin mixture (in 1 L water, 50 mg biotin, 1 g Ca-pantothenate, 1 g nicotinic acid, 25 g myoinositol, 1 g thiamine chloride hydrochloride, 1 g pyridoxol hydrochloride, 0.2 g p-aminobenzoic acid) 6 mL of a trace mineral solution (in 1 L water, 15 g EDTA, 4.5 g zinc sulfate heptahydrate, 0.8 g manganese chloride dehydrate, 0.3 g cobalt chloride hexahydrate, 0.3 g copper sulfate pentahydrate, 0.4 g disodium molybdenum dehydrate, 4.5 g calcium chloride dihydrate, 3 g iron sulfate heptahydrate, 1 g boric acid, 0.1 g potassium iodide), 30 mg thiamine HCl, 30 mg nicotinic acid. The pH was adjusted to 5.2 with 2N KOH and glucose added to 10 g/L.

Preparation of Inoculum

A 125 mL shake flask was inoculated directly from a frozen vial by pipetting the whole vial culture (approx. 1 ml) into 10 mL of the inoculum medium. The flask was incubated at 260 rpm and 30° C. The strain was grown overnight until OD about 1.0. OD at λ=600 nm was determined in a Beckman spectrophotometer (Beckman, USA).

Bioreactor Experimental Design

Fermentations were carried out in 1 L Biostat B DCU3 fermenters (Sartorius, USA) with a working volume on 0.8 L. Off-gas composition was monitored by a Prima DB mass spectrometer (Thermo Electron Corp., USA). The temperature was maintained at 30 C and pH controlled at 5.2 with 2N KOH throughout the entire fermentation. Directly after inoculation with 80 mL of the inoculum, dO was controlled by agitation at 30%, pH was controlled at 5.25, aeration was controlled at 0.2 L/min. Once OD of approximately 3 was reached, the gas was switched to N2 for anaerobic cultivation. Throughout the fermentation, glucose was maintained in excess (5-20 g/L) by manual additions of a 50% (w/w) solution.

Methods for Analyzing Cultivation Experiments

OD at λ=600 nm was determined in a spectrophotometer by pipetting a well mixed broth sample into a cuvette (CS500 VWR International, Germany). If biomass concentration of the sample exceeded the linear absorption range of the spectrophotometer (typically OD values from 0.000 to 0.300), the sample was diluted with 0.9% NaCl solution to yield values in the linear range.

Measurements of glucose, isobutanol, and other fermentation byproducts in the culture supernatant were carried out by HPLC, using a Bio-Rad Aminex HPX-87H column (Bio-Rad, USA), with refractive index (RI) and a diode array (210 nm) detectors. Chromatographic separation was achieved using 0.01 N $H_2SO_4$ as the mobile phase with a flow rate of 0.6 mL/min and a column temperature of 40° C. Isobutanol retention time is 32.2 minutes under these conditions. Isobutanol concentration in off-gas samples was determined by mass-spectrometer.

Results

Figure 5:
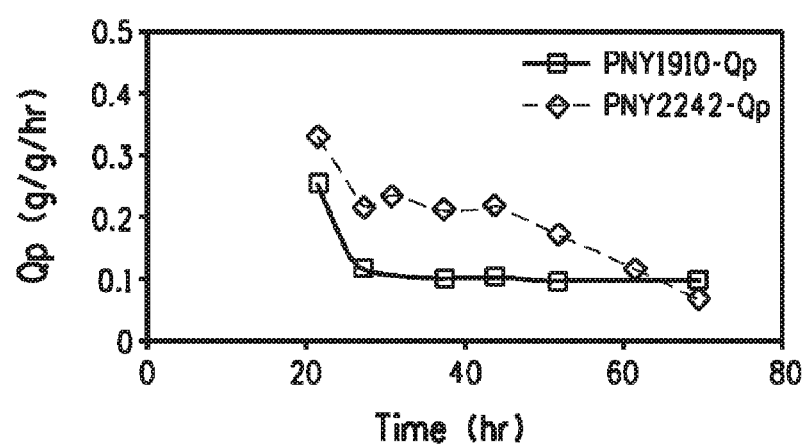
FIG. 5 shows the specific rate of isobutanol production, Qp, of the two strains, PNY1910 and PNY2242.
Figure 6:
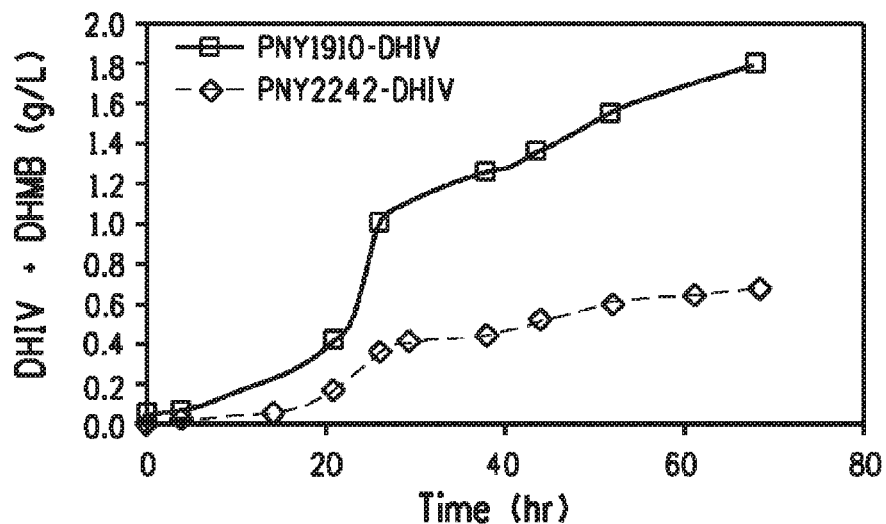
FIG. 6 shows the accumulation of DHIV+DHMB in the culture supernatant during the fermentation time course with PNY1910 (triangles) and PNY2242 (diamonds). (DHMB and DHIV are not distinguished by the HPLC method used.)
Figure 7:
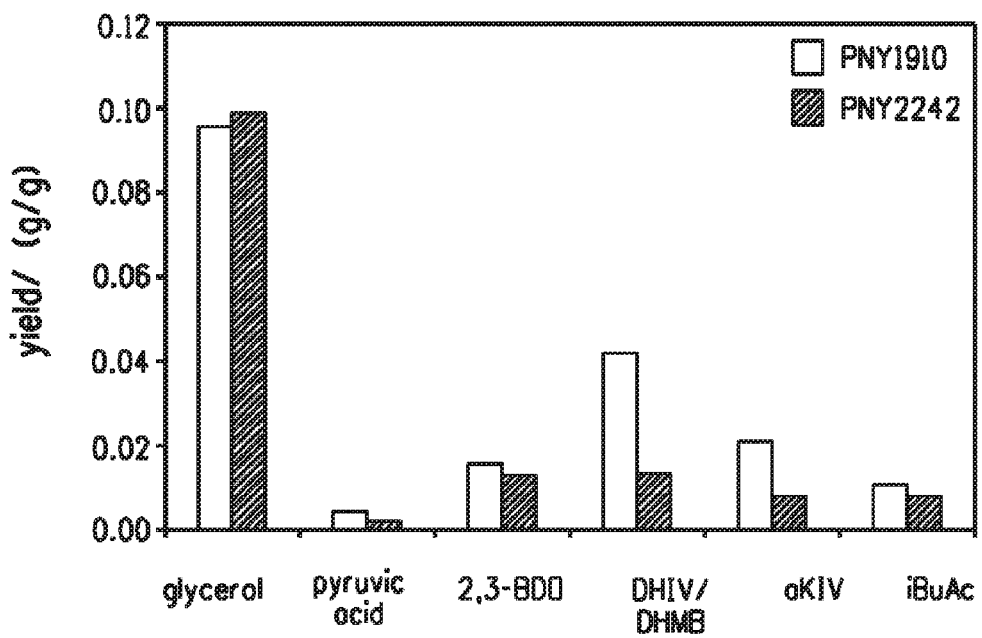
FIG. 7 shows the yield of glycerol, pyruvic acid, 2,3-butanediol (BDO), DHIV/DHMB, α-ketoisovalerate (aKIV), and isobutyric acid (iBuAc), DHIV and DHMB are shown together as these are not distinguished by the HPLC method used.

Maximal biomass concentration measured as optical density (OD), volumetric rate of isobutanol production, final isobutanol titer, and isobutanol yield on glucose are presented in the table below. The strain PNY2242 had higher titers and faster rates than the strain PNY1910 and produced isobutanol with higher specific rate and titer. The specific rates are shown in FIG. 5. Accumulation of the DHIV+DHMB in the culture supernatant was three times higher with PNY1910 compared to the PNY2242 strain (FIG. 6). Yield of glycerol, pyruvic acid, BDO, DHIV+DHMB*, αKIV, and isobutyric acid on glucose is shown in FIG. 7.

*DHIV analyzed by HPLC method includes both DHIV and DHMB.

TABLE 19

| Strain | Max. OD600 | Rate (g/L/h) | Titer (g/L) | Yield (g/g) |
|---|---|---|---|---|
| PNY1910 | 5.0 | 0.16 | 10.9 | 0.25 |
| PNY2242 | 5.0 | 0.23 | 16.1 | 0.27 |

Example 15

Construction of K9G9 Error Prone PCR Library

Error prone PCR of K9G9 was performed to generate a library that can be screened for variants with increases in the Km values for NADPH relative to NADH. Mutagenic PCR of K9G9 was performed with the GeneMorph® II EZClone Domain Mutagenesis Kit (Catalog #200552; Agilent Technologies, Stratagene Products Division, La Jolla, Calif.). Primers K9G9_EZ_F1 (AAA CAT GGA AGA ATG TAA GAT GGC; SEQ ID NO: 390) and K9G9_EZ_R1 (TCA GTT GTT AAT CAA CTT GTC TTC G; SEQ ID NO: 391) were commercially synthesized by Integrated DNA Technologies, Inc (Coralville Iowa). Other than the primers, template, and ddH$_2$O, reagents used here were supplied with the kit indicated above. The mutagenic PCR mixture consisted of 4 µl of pHR81-PIlv5-KARI-K9.G9 (SEQ ID NO: 392) (770 ng/µg), 1.25 µl of each primer (100 ng/µl stocks), 5 µl of 10× Mutazyme II reaction buffer, 1 µl of 40 mM dNTP mix, 1.5 µl of Mutazyme II DNA polymerase, and 36 µl of ddH$_2$O. The following conditions were used for the PCR reaction: The starting temperature was 95° C. for 2.0 min followed by 30 heating/cooling cycles. Each cycle consisted of 95° C. for 30 sec, 48° C. for 30 sec, and 72° C. for 2.0 min. At the completion of the temperature cycling, the sample was kept at 72° C. for 10.0 min more, and then held awaiting sample recovery at 4° C. The reaction product was separated from the template via agarose gel electrophoresis (1% agarose, 1×TBE buffer) and recovered using the StrataPrep® DNA Gel Extraction Kit (Cat #400766, Agilent Technologies, Stratagene Products Division, La Jolla, Calif.) as recommended by the manufacturer.

The isolated reaction product was employed as a megaprimer to generate gene libraries in the "EZClone reaction" of the kit indicated above. Other than the megaprimer, template, and ddH$_2$O, reagents used here were supplied with the kit indicated above. The reaction consisted of 25 µl of the 2×EZClone enzyme mix, 4 µl of megaprimer (125 ng/µl), 2 µl of K9G9 in a pBAD.KARI vector (25 ng/µl), 3 µl of EZClone solution, and 16 µl of ddH$_2$O. The following conditions were used for the reaction: The starting temperature was 95° C. for 1.0 min followed by 30 heating/cooling cycles. Each cycle consisted of 95° C. for 50 sec, 60° C. for 50 sec, and 68° C. for 10.0 min. At the completion of the temperature cycling, the samples were kept at 72° C. for 10.0 min more, and then held awaiting sample recovery at 4° C. 1 µl of the Dpn I (10 U/µl) was added and the mixture was incubated for 4 hours at 37° C.

4 µl of the Dpn I digested "EZClone reaction" product was then transformed into 50 µl XL10-Gold® Ultracompetent E. coli cells (provided in the GeneMorph® II EZClone Domain Mutagenesis Kit) as recommended by the manufacturer. The transformants were spread on agar plates containing the LB medium and 100 µg/ml ampicillin (Cat #L1004, Teknova Inc. Hollister, Calif.), incubated at 37° C. overnight, and store at 4° C. These steps were repeated with 4 µl Dpn I digested "EZClone reaction" product and 50 µl cells per transformation for a total of 10 transformations. The resultant library in XL-Gold was scraped off the agar plates with a solution containing M9 salts, combined, diluted into media containing the LB medium and 100 µg/ml ampicillin, and incubated at 37° C. overnight. The library DNA was isolated from the cells with the QIAprep Spin Miniprep Kit (Catalog #2706; Qiagen, Valencia, Calif.) according to the protocol provided by the manufacturer. The amplified library was then used to transform an electro-competent strain of E. coli Bw25113 (ΔilvC) using a BioRad Gene Pulser II (Bio-Rad Laboratories Inc., Hercules, Calif.). The transformed clones were spread on agar plates containing the LB medium and 100 µg/ml ampicillin (#101320-154, Teknova Inc. Hollister, Calif.) and incubated at 37° C. overnight. Clones were employed for high throughput screening as described in Example 16.

Example 16

Identification of K9G9 Variants with Increased K$_M$ for NADPH Via Screening for Diminished NADP+ Inhibition of NADH Activity The K9G9 library described in Example 15 was screened for variants with reduced NADP$^+$ inhibition of NADH-dependent KARI activity. A K9G9 variant with reduced NADP$^+$ inhibition of activity with NADH can potentially exhibit an increase in the ratio of the K$_M$ for NADPH to the K$_M$ for NADH. With a specific objective to increase K$_M$ for NADPH relative to Km for NADH, the hits from the screen were partially purified and kinetic analyses were performed to determine V$_{max}$ and K$_M$ parameters with NADH and with NADPH.

High Throughput Screening Assay of K9G9 Gene Library

High throughput screening of the gene libraries of mutant KARI enzymes was performed as described herein: 10× freezing medium containing 554.4 g/L glycerol, 68 mM of (NH$_4$)$_2$SO$_4$, 4 mM MgSO$_4$, 17 mM sodium citrate, 132 mM KH$_2$PO$_4$, 36 mM K2HPO$_4$ was prepared with molecular pure water and filter-sterilized. Freezing medium was prepared by diluting the 10× freezing medium with the LB medium. An aliquot (200 µL) of the 1× freezing medium was used for each well of the 96-well archive plates (cat #3370, Corning Inc. Corning, N.Y.).

Clones from the LB agar plates were selected and inoculated into the 96-wed archive plates containing the freezing medium and grown overnight at 37° C. without shaking. The archive plates were then stored at −80° C. E. coli strain Bw25113(ΔilvC), as described in U.S. Pat. No. 8,129,162, transformed with pBAD-HisB (Invitrogen) was always used as the negative control. The positive control for the library was K9G9-KARI in E. coli strain Bw25113 (ΔilvC), as described in U.S. Pat. No. 8,129,162.

Clones from archive plates were inoculated into the 96-deep well plates. Each well contained 3.0 µl of cells from thawed archive plates, 200 µl of the LB medium containing 100 µg/ml ampicillin and 0.02% (w/v) arabinose as the inducer. Cells were the grown overnight at 37° C. with 80% humidity while shaking (900 rpm), harvested by centrifugation (3750 rpm, 5 min at 25° C.). (Eppendorf centrifuge, Brinkmann Instruments, Inc. Westbury, N.Y.) and the cell pellet was stored at −20° C. for later analysis.

The assay substrate, (R,S)-acetolactate, was synthesized as described by Aulabaugh and Schloss (Aulabaugh and Schloss, Biochemistry, 29: 2824-2830, 1990). All other chemicals used in the assay were purchased from Sigma. The enzymatic conversion of acetolactate to α,β-dihydroxyisovalerate by KARI was followed by measuring the oxidation of the cofactor, NADH, from the reaction at 340 nm using a plate reader (Saphire 2, Tecan, Mannedorf, Switzerland). The activity was calculated using the molar extinction coefficient of 6220 M$^{-1}$cm$^{-1}$ NADH.

Frozen cell pellet in deep-well plates and BugBuster (Novagen 71456, Darmstadt, Germany) were warmed up at room temperature for 30 min at the same time. 75 µl of 50% BugBuster (v/v in water) was added to each well after 30 min warm-up and cells were suspended using plate shaker. The plates with cell pellet/50% Bug Buster suspension were incubated at room temperature for 30 min. Cell lysate diluted with 75 µL d.d water, resulting in 0.5× lysate. Assays of the diluted cell free extracts were performed at 30° C. in buffer containing 2.4 mM (R/S)-acetolactate, 100 mM HEPES pH 6.8, 100 mM KCl, 10 mM MgCl$_2$, 150 µM NADH, 12.5 µL 0.5× cell lysate with or without 2.5 mM NADP+.

Identification of K9G9 Variants with Reduced NADP+ Inhibition of NADH KARI Activity The ratio for the measured rate of NADH oxidation in the presence of NADP+ to the measured rate of NADH oxidation in the absence of NADP+ was calculated for each variant and positive control well (2 per plate). The mean and standard deviation of ratios for all of the positive control wells (104 total) were calculated.

A variant well was considered to contain an initial hit if the rate in the absence of NADP+ was greater than 0.1 OD/hr and the rate ratio was both greater than 0.45 (three standard deviations higher than the positive control mean) and less than 1. A total of 521 hits were identified from a pool of 4607 potential variants. These initial hits were consolidated, forming a smaller library for further analysis.

Secondary Screening of Initial Library Hit

The consolidated hit library was grown in biological triplicate and cell free extracts were prepared and assayed as described above. Rate ratios were then calculated for the variants and positive controls as above. Final hits that were selected for detailed kinetic analysis met the following criteria: the rate in the absence of NADP+ was greater than 0.6 OD/hr, rate ratio was greater than 0.51 and less than 1, and at least two out of three biological replicates passed the criteria. Seventeen hits were identified for kinetic analysis and streaked out on to LB plates with 100 μg/mL ampicillin added.

Sequence Analysis of K9G9 Variants

DNA sequencing of the seventeen variants identified from the secondary HTS screening was accomplished by using TempliPhi™ (GE Healthcare) with the primers pBAD-For (ATGCCATAGCATTTTTATCC; SEQ ID NO: 393) and pBAD-Rev (CTGATTTAATCTGTATCAGGCT; SEQ ID NO: 394).

TABLE 20

Amino Acid Substitutions for K9G9 Variants

| Variant | Seq | Amino Acid Substitutions |
|---|---|---|
| 878 C1 | 873 | None identified |
| 879 A7 | 874 | K90M |
| 879 C2 | 875 | H37Q |
| 880 A11 | 876 | A182T, P320Q |
| 880 B4 | 877 | K57E |
| 880 D11 | 878 | K90M, A174V |
| 881 A2 | 879 | K90M, I133V, K282T |
| 881 G3 | 880 | Y53F, E74G |
| 881 G9 | 881 | K90E |
| 882 B12 | 882 | H118R |
| 882 C10 | 883 | G31S, R61S, C121Y, D129N, G183D |
| 882 C7 | 933 | E54G |
| 882 F9 | 934 | K90E, Q160H |
| 882 G6 | 935 | G55A |
| 882 G12 | 936 | V142L, S285Y |
| 883 C4 | 937 | A170V |
| 883 G9 | 938 | L197M, K310M |

Kinetic Analysis of Partially Purified Variant Protein

*E. coli* strain Bw25113 (ΔilvC), as described in U.S. Pat. No. 8,129,162, was used to express the seventeen variants and positive control K9G9. Strains were grown for 8 hours in 10 mL of LB broth (#46-060-CM, Mediatech, Manassas, Va.) containing 100 μg/mL ampicillin at 37° C. with shaking in 125 mL baffled, vented filtered lid flasks. 200 μL of this culture was used to inoculate 100 mL LB broth with 100 μg/mL ampicillin and 0.2% (w/v) arabinose added. These cultures were grown for 16 to 18 hours at 37° C. with shaking in 500 mL baffled, vented filtered lid flasks. Cells were harvested in a 20 mL and two 40 mL aliquots, supernatants were decanted and the pellets were frozen at −80° C.

To partially purify the protein, the cell pellet corresponding with the 20 mL cell culture harvest was thawed and resuspended in 1 mL Bug Buster Master Mix (Novagen 71456, Darmstadt, Germany). The cell suspension was incubated at room temperature for 15 minutes followed by 15 minute incubation at 60° C. to denature the heat liable proteins. Cell debris and denatured proteins were pelleted by centrifugation for 30 minutes at 4° C. Supernatant containing the heat stable cytosolic protein, including K9G9 and variants, was recovered and stored at 4° C.

The total protein of the heat stable cytosolic protein fraction was measured by the Bradford Assay using Coomaisse Plus (Thermo Scientific #23238, Rockford, Ill.). BSA was employed as the standard. The concentration of protein was measured by determining the absorbance at 595 nm using a Cary 300 spectrophotometer (Agilent Technologies, Wilmington, Del.).

To determine $V_{max}$ and $K_M$ values for NADH and NADPH, the partially purified proteins were assayed at various concentrations of NADH (0, 16.4, 32.8, 65.7, 98.5, 164.3 and 246.5 μM) and NADPH (0, 12.8, 25.6, 51.2, 76.8 and 128 μM). Assays were conducted at 30° C. in 100 mM HEPES (pH 6.8), 10 mM $MgCl_2$, 100 mM KCl and 4.8 mM R/S-acetolactate. Between 0.1 to 0.35 mg/mL total protein was added to the assay. The rate of conversion of S-acetolactate to DHIV was measured via monitoring the oxidation of NAD(P)H at 340 nm using a Cary 300 spectrophotometer (Agilent Technologies, Wilmington, Del.). The activity was calculated using the molar extinction coefficient of 6220 $M^{-1}cm^{-1}$. $V_{max}$ and $K_m$ values were calculated by plotting specific activity (U/mg) vs. cofactor concentration and the data were fit to the Michaelis-Menten equation using Kaleidagraph software (Synergy, Reading, Pa.).

TABLE 21

Kinetic Values for Partially Purified K9G9 Variants as Determined via NAD(P)H Consumption Assays

| Variant | $V_{max}$ NADPH, U/mg | $K_m$ NADPH, μM | $V_{max}/K_m$ NADPH, L/min * mg | $V_{max}$ NADH, U/mg | $K_m$ NADH, μM | $V_{max}/K_m$ NADH, L/min * mg |
|---|---|---|---|---|---|---|
| K9G9 | 1.53 | 45.5 | 0.034 | 1.09 | 67.4 | 0.016 |
| 878 C1 | 0.75 | 42.2 | 0.018 | 0.62 | 107.8 | 0.006 |
| 879 A7 | 2.51 | 546 | 0.005 | 1.44 | 263 | 0.006 |
| 879 C2 | 1.27 | 103 | 0.012 | 1.23 | 187 | 0.007 |
| 880 A11 | 0.72 | 86.9 | 0.008 | 0.51 | 117 | 0.004 |
| 880 B4 | 1.23 | 233 | 0.005 | 1.14 | 133 | 0.009 |
| 880 D11 | 1.38 | 130 | 0.011 | 1.50 | 232 | 0.006 |
| 881 A2 | 0.88 | 93.5 | 0.009 | 1.13 | 166.8 | 0.007 |
| 881 G3 | 0.69 | 99.2 | 0.007 | 0.69 | 61.8 | 0.011 |
| 881 G9 | 1.03 | 158 | 0.007 | 0.96 | 310 | 0.003 |
| 882 B12 | 0.87 | 30.3 | 0.029 | 0.49 | 78.9 | 0.006 |
| 882 C10 | 0.71 | 34.1 | 0.021 | 0.56 | 97.9 | 0.006 |
| 882 C7 | 1.62 | 45.3 | 0.036 | 0.96 | 75.6 | 0.013 |
| 882 F9 | 1.39 | 256 | 0.005 | 1.19 | 335 | 0.004 |
| 882 G6 | 0.95 | 47.4 | 0.020 | 0.74 | 98.7 | 0.007 |
| 882 G12 | 1.06 | 63.5 | 0.017 | 0.75 | 81.2 | 0.009 |

TABLE 21-continued

Kinetic Values for Partially Purified K9G9 Variants as Determined via NAD(P)H Consumption Assays

| Variant | $V_{max}$ NADPH, U/mg | $K_m$ NADPH, μM | $V_{max}/K_m$ NADPH, L/min * mg | $V_{max}$ NADH, U/mg | $K_m$ NADH, μM | $V_{max}/K_m$ NADH, L/min * mg |
|---|---|---|---|---|---|---|
| 883 C4 | 1.26 | 46.8 | 0.027 | 0.67 | 83.9 | 0.008 |
| 883 G9 | 1.26 | 38 | 0.033 | 1.01 | 71.9 | 0.014 |

Example 17

Manual Recombination of K9 KARI Variants Via Site Directed Mutagenesis

Site directed mutagenesis of the K9G9 derivatives K9JB4 and K9JG3 (identified in Example 16 as 880 B4 and 881 G3, respectively) was performed to incorporate other amino acid changes described in the examples. The initial step was to add to the N87P substitution, which is described in Example 5. Mutations were introduced into the KARI genes with primers N87PC1 (CTGACATCATTATGATCTTGATCCCA-GATGAAAAGCAGGCTACCATG TAC; SEQ ID NO: 395) and N87PC1r (GTACATGGTAGCCTGCTTTTCATCTGG-GATCAAGATCATAATGATGT CAG; SEQ ID NO: 396), employing the QuikChange® II Site-Directed Mutagenesis Kit (Catalog #200523; Agilent Technologies, Stratagene Products Division, La Jolla, Calif.). Except for the primers, templates, and ddH$_2$O, all reagents used here were supplied with the kit indicated above. Primers were commercially synthesized by Integrated DNA Technologies, Inc (Coralville Iowa). Templates were K9 KARI variants in E. coli vectors (pBAD.KARI). For mutagenesis of K9JB4, the reaction mixture contained 1 μl K9JB4 (50 ng/μl), 1 μl of each primer (150 ng/ul), 5 μl of 10× reaction buffer, 1 μl of dNTP mix, 1 μl of Pfu Ultra HF DNA polymerase, and 40 μl of ddH$_2$O. For, the K9JG3 reaction mixture, 1 μl K9JB4 (50 ng/ul) was substituted with 1 μl K9JG3 (50 ng/μl). The following conditions were used for both reactions: The starting temperature was 95° C. for 30 sec followed by 16 heating/cooling cycles. Each cycle consisted of 95° C. for 30 sec, 55° C. for 30 sec, and 68° C. for 5.0 min. At the completion of the temperature cycling, the samples held awaiting sample recovery at 4° C. 1 μl of the Dpn I (10 U/μl) was added to each reaction and the mixtures were incubated for 1 hour at 37° C.

2 μl of each mutagenic reaction was transformed into One Shot® TOP10 Chemically Competent E. coli (Invitrogen, Catalog #C404003) according to the manufacturer's instructions. The transformants were spread on agar plates containing the LB medium and 100 μg/ml ampicillin (Cat #L1004, Teknova Inc. Hollister, Calif.) and incubated at 37° C. overnight. Multiple transformants were then selected for TempliPhi™ (GE Healthcare) based DNA sequencing employing primers pBAD-For (ATGCCATAGCATTTTTATCC; SEQ ID NO: 393) and pBAD-Rev (CTGATTTAATCTGTAT-CAGGCT; SEQ ID NO: 394). Transformants with confirmed KARI sequences were inoculated into LB medium containing 100 μg/ml ampicillin and incubated at 33° C. with shaking at 225 rpm. Plasmid DNA was isolated from the cells with the QIAprep Spin Miniprep Kit (Catalog #2706; Qiagen, Valencia, Calif.) according to the protocol provided by the manufacturer. The resultant clones K9JB4P and K9JG3P were derived from K9JB4 and K9JG3, respectively.

Additional site directed mutagenesis was performed as described above with modifications.

Variant K9JA1 was derived from K9JG3P employing primers oK57E1 (GGTTTATTCGAAGGTGCGGAG-GAGTGGAAAAGAGCTG; SEQ ID NO: 397) and oK57E1r (CAGCTCTTTTCCACTCCTCCGCACCTTC-GAATAAACC; SEQ ID NO: 398). The mutagenesis reaction contained 1 μl K9JG3P (50 ng/μl), 1 μl of each primer (150 ng/ul), 5 μl of 10× reaction buffer, 1 μl of dNTP mix, 1 μl of PfuUltra HF DNA polymerase, and 40 μl of ddH$_2$O. Liquid cultures for E. coli transformants were incubated at 37° C. instead of 33° C.

Variant K9SB2 was derived from K9JB4P employing primers oY53F1 (GTAACGTTATCATTGGTTTATAC-GAAGGTGCGGAGGAG; SEQ ID NO: 399) and oY53F1r (CTCCTCCGCACCTTCGAATAAACCAAT-GATAACGTTAC; SEQ ID NO: 400). The mutagenesis reaction contained 1 μl K9JB4P (50 ng/μl), 1 μl of each primer (150 ng/ul), 5 μl of 10× reaction buffer, 1 μl of dNTP mix, 1 μl of PfuUltra HF DNA polymerase, and 40 μl of ddH2O. Liquid cultures for E. coli transformants were incubated at 37° C. instead of 33° C.

Variant K9SB2-K90L was derived from K9SB2 employing primers oK90L1 (GATCTTGATCCCAGATGAATTG-CAGGCTACCATGTACAAAAA C; SEQ ID NO: 401) and oK90L1r (GTT TTT GTA CAT GGT AGC CTG CAA TTC ATC TGG GAT CAA GAT C; SEQ ID NO: 402). The mutagenesis reaction contained 2.5 μl K9SB2 (50 ng/μl), 1 μl of each primer (150 ng/ul), 5 μl of 10× reaction buffer, 1 μl of dNTP mix, 1 μl of PfuUltra HF DNA polymerase, and 38.5 μl of ddH$_2$O. For the heating/cooling cycles, the step of 55° C. for 30 sec was increased to 1 min. Liquid cultures for E. coli transformants were incubated at 37° C. instead of 33° C.

Variant K9SB2-K90M was derived from K9SB2 employing primers oK90M1 (CTTGATCCCAGATGAAATGCAG-GCTACCATGTACAAAAAC; SEQ ID NO: 403) and oK90M1r (GTT TTT GTA CAT GGT AGO CTG CAT TTC ATC TGG GAT CAA G; SEQ ID NO: 404). The mutagenesis reaction contained 2.5 μl K9SB2 (50 ng/μl), 1 μl of each primer (150 ng/ul), 5 μl of 10× reaction buffer, 1 μl of dNTP mix, 1 μl of PfuUltra HF DNA polymerase, and 38.5 μl of ddH$_2$O. For the heating/cooling cycles, the step of 55° C. for 30 sec was increased to 1 min. Liquid cultures for E. coli transformants were incubated at 37° C. instead of 33° C.

TABLE 22

Amino Acid Substitutions of K9G9 Variants and Combinations

| Variant | Amino Acid Seq ID No: | Nucleic Acid SEQ ID NO: | Amino Acid Substitutions |
|---|---|---|---|
| K9JB4 | 417 | 418 | S56A, K57E, S58E |
| K9JB4P | 419 | 420 | S56A, K57E, S58E, N87P |
| K9JG3 | 421 | 422 | Y53F, S56A, S58E, E74G |
| K9JG3P | 423 | 424 | Y53F, S56A, S58E, E74G, N87P |

TABLE 22-continued

Amino Acid Substitutions of K9G9 Variants and Combinations

| Variant | Amino Acid Seq ID No: | Nucleic Acid SEQ ID NO: | Amino Acid Substitutions |
|---|---|---|---|
| K9JA1 | 425 | 426 | Y53F, S56A, K57E, S58E, E74G, N87P |
| K9SB2 | 427 | 428 | Y53F, S56A, K57E, S58E, N87P |
| K9SB2-K90L | 429 | 430 | Y53F, S56A, K57E, S58E, N87P, K90L |
| K9SB2-K90M | 431 | 432 | Y53F, S56A, K57E, S58E, N87P, K90M |

Example 18

Kinetic Characterization of Purified K9G9 Derivatives with Increased Ratios of $K_M$ NADPH to $K_M$ NADH K9G9 and variants were overexpressed in *E. coli* strain Bw25113 (ΔilvC), as described in U.S. Pat. No. 8,129,162, and purified in order to obtain a more accurate determination of cofactor affinity and maximum velocity.

For expression and characterization, *E. coli* plasmids (pBAD.KARI) were used to transform an electro-competent strain of *E. coli* Bw25113 (ΔilvC) as described in U.S. Pat. No. 8,129,162, using a BioRad Gene Pulser II (Bio-Rad Laboratories Inc., Hercules, Calif.). The transformed clones were spread on agar plates containing the LB medium and 100 µg/ml ampicillin (#101320-154, Teknova Inc. Hollister, Calif.) and incubated at 37° C. overnight. A single transformant for each strain was streaked out onto LB plates with 100 µg/mL ampicillin. A single colony from each of these plates was used to inoculate 10 mL LB broth with 100 µg/mL ampicillin. These cultures were grown for 8 hours at 37° C. with shaking in 125 mL baffled flasks with vented, filtered lids. 200 µL of this culture was used to inoculate two 500 mL baffled flasks with filtered vented lids containing LB broth with 100 µg/mL ampicillin and 0.2% (w/v) arabinose. The expression cultures were grown for 16-18 hours at 37° C. with shaking. Cells were harvested in 40 mL aliquots via centrifugation; the supernatant was discarded and cell pellets were frozen at –80° C. until purification.

K9G9 and all variants were purified using the same process. Two cell pellets, representing 40 mL cell culture aliquots each, were resuspended in 4 mL Bug Buster Master Mix (Novagen 71456, Darmstadt, Germany) and incubated for 15 minutes at room temperature followed by 15 minutes at 60° C. Denatured proteins and cell debris was pelleted by centrifugation at 7,000 rpm for 30 minutes and 4° C. The supernatant was decanted, save and filtered through a Acrodisc 0.2 µm syringe filter (PN4192, Pall, Ann Arbor, Mich.). K9G9 was purified from the filtered heat treated cell free extract using a GE Healthcare HiLoad 26/60 Superdex 200 gel filtration column (17-1071-01, Buckinghamshire, England). The column was pre-equilibrated with 0.2 CV equilibration with 50 mM HEPES (pH 7.5) 5 mM MgCl$_2$ buffer at a 2.0 mL/min flow rate prior to protein loading, K9G9 and variants were eluted over a 1.5 CV isocratic step consisting of 50 mM HEPES (pH 7.5) 5 mM MgCl$_2$ buffer at a 2.0 mL/min flow rate. Fractions 2.5 mL in volume were collected using a Frac-950 fraction collector (Buckinghamshire, England) in a serpentine pattern, K9G9 and variants all eluted between fractions D5-E5 or D6-E4. Fractions were pooled using a 15 mL Amicon Ultra YM-30 spin filter (UFC903008, Millipore, Billercia, Mass.) and washed with 10 mL 100 mM HEPES (pH 6.8) and 10 mM MgCl$_2$ buffer. Filtrate was discarded and the purified protein was eluted from the membrane using 1 mL buffer containing 100 mM HEPES (pH 6.8) and 10 mM MgCl$_2$.

To determine V$_{max}$ and K$_M$ values for NADH and NADPH, the purified proteins were assayed at various concentrations of NAD(P)H (0 to 1000 µM) coupled with a NAD(P)H regeneration system. Assays were conducted at 30° C. in a buffer containing 100 mM MOPS, pH 6.8, 10 mM MgCl2, 1 mM EDTA, 5 mM (R/S)-acetolactate, 1 mM glucose-6-phosphate, 3 mU/µL glucose-6-phosphate dehydrogenase. The reaction as quenched after ten minutes with three volumes 0.1% formic acid. DHIV concentration was measured using LC-MS. The rate of conversion of S-acetolactate to DHIV was determined by measuring the amount of DHIV produced at a fixed time point. V$_{max}$ and K$_m$ values were calculated by plotting specific activity (U/mg) vs. cofactor concentration and the data were fit to the Michaelis-Menten equation. Measurements of acetolactate Km values (at a fixed concentration of NADH) indicated that the fixed acetolactate concentration employed for the cofactor Km determinations was saturating.

TABLE 23

Kinetic Values for Purified K9G9 Variants as Determined via DHIV Formation Assays

| Variant | $V_{max}$ NADPH, U/mg | $K_m$ NADPH, µM | $V_{max}/K_m$ NADPH, L/min * mg | $V_{max}$ NADH, U/mg | $K_m$ NADH, µM | $V_{max}/K_m$ NADH, L/min * mg |
|---|---|---|---|---|---|---|
| K9G9 | 2.2 | 24.1 | 0.091 | 1.9 | 78.2 | 0.024 |
| K9JB4 | 2.7 | 249 | 0.011 | 3.4 | 115 | 0.030 |
| K9JB4P | 2 | 83.2 | 0.024 | 2.9 | 34.1 | 0.085 |
| K9G3 | 3.1 | 113 | 0.027 | 2.8 | 106 | 0.026 |
| K9G3P | 1.8 | 33.6 | 0.054 | 2.1 | 18.1 | 0.116 |
| K9JA1 | 2.6 | 63.4 | 0.041 | 3.4 | 14 | 0.243 |
| K9SB2 | 1.7 | 44.8 | 0.038 | 1.8 | 11.6 | 0.155 |
| K9SB2-K90L | 2.1 | 173 | 0.012 | 2.4 | 28.6 | 0.084 |
| K9SB2-K90M | 1.8 | 245 | 0.007 | 2.2 | 41.3 | 0.053 |

Example 19

Isobutanol Production of K9G9 Derivatives with Increased Ratios of $K_m$ NADPH to $K_m$ NADH The yeast expression plasmids for K9JB4, K9JB4P, K9JG3, K9JG3P, K9JA1, and K9SB2 were made by subcloning of the variant KARI genes from *E. coli* vectors (pBAD.KARI) into pHR81-PIlv5-KARI-K9.G9 at PmeI and SfiI sites. The resultant plasmids together with pHR81-PIlv5-KARI-K9.G9 and pHR81-PIlv5-KARI-K9D3 (SEQ ID NO: 181) were analyzed for isobutanol production and by-product formation in yeast. Yeast pathway strains were made in PNY2259 (MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ:P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t ymr226cΔ ald6Δ::loxP; Example 22) host by co-transforming the KARI vectors as pathway plasmid #1, and pBP915 (pRS423-$P_{FBA1}$-DHAD-$P_{GPM1}$-hADH1; SEQ ID NO: 182) as pathway plasmid #2. The transformed cells were plated on synthetic medium without histidine or uracil (1% ethanol as carbon source). Three transformants were transferred to fresh plates of the same media. The transformants were tested for isobutanol production under anaerobic conditions in serum vials.

Yeast colonies from the transformation on SE-Ura-His plates appeared after 3-5 days. The three colonies from each variant were patched onto fresh SE-Ura-His plates, incubate at 30° C. for 3 days.

Growth Media and Procedure

Two types of media were used during the growth procedure of yeast strains: an aerobic pre-culture media and an anaerobic culture media. All chemicals were obtained from Sigma unless otherwise noted (St. Louis, Mo.)

Aerobic pre-culture media (SE-Ura-His): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% tryptophan, 30 mg/L nicotinic acid, 30 mg/L thiamine and 10 mg/L ergosterol made up in 50/50 v/v Tween/ethanol solution.

The patched cells were inoculated into 25 mL SEG-Ura, His media with 0.2% glucose and 0.2% ethanol, and grown under progressively oxygen-limited conditions with lid closed for approximately 48 hours at 30° C. with shaking, until a target $OD_{600}$ value of approximately 1.5 to 2 was achieved. $OD_{600}$ values were recorded. Cells were pelleted via centrifugation and the supernatant was discarded. Cell pellets were transferred into a Coy Anaerobic Bag (Grass Lake, Mich.) where pellets were resuspended in 1.0 mL anaerobic growth media (SEG-Ura-His). The resuspended cell pellets were used to inoculate 30 mL SEG-Ura-His media in 50 mL serum bottles (Wheaton, 223748, Millville, N.J.) to a target initial $OD_{600}$ value of 0.2. All anaerobic media, serum vials, stoppers and crimps were allowed to degas in the anaerobic bag for at least 24 hours prior to inoculation. Serum bottles were stoppered, crimped and transferred out of the anaerobic bag and grown at 30° C. with shaking at 240 rpm. Anaerobic cultures were grown for 24 to 72 hours with a target $OD_{600}$ value of at least 1.2. Additional anaerobic growth steps used the cells from the previous anaerobic culture step as inoculant. Three transformants were evaluated for each variant.

HPLC Analysis of Yeast Strains with K9G9 KARI Variants

Samples were taken for HPLC analysis and to obtain $OD_{600}$ values at the end of the anaerobic growth period. HPLC analysis was performed using a Waters 2695 separations unit, 2996 photodiode array detector, and 2414 refractive index detector (Waters, Milford, Mass.) with a Shodex Sugar SH-G pre-column and Shodex Sugar SH1011 separations column (Shodex, JM Science, Grand Island, N.Y.). Compounds were separated by isocratic elution at 0.01 N sulfuric acid with a flow rate of 0.5 mL/min. Chromatograms were analyzed using the Waters Empower Pro software.

Figure 9B:
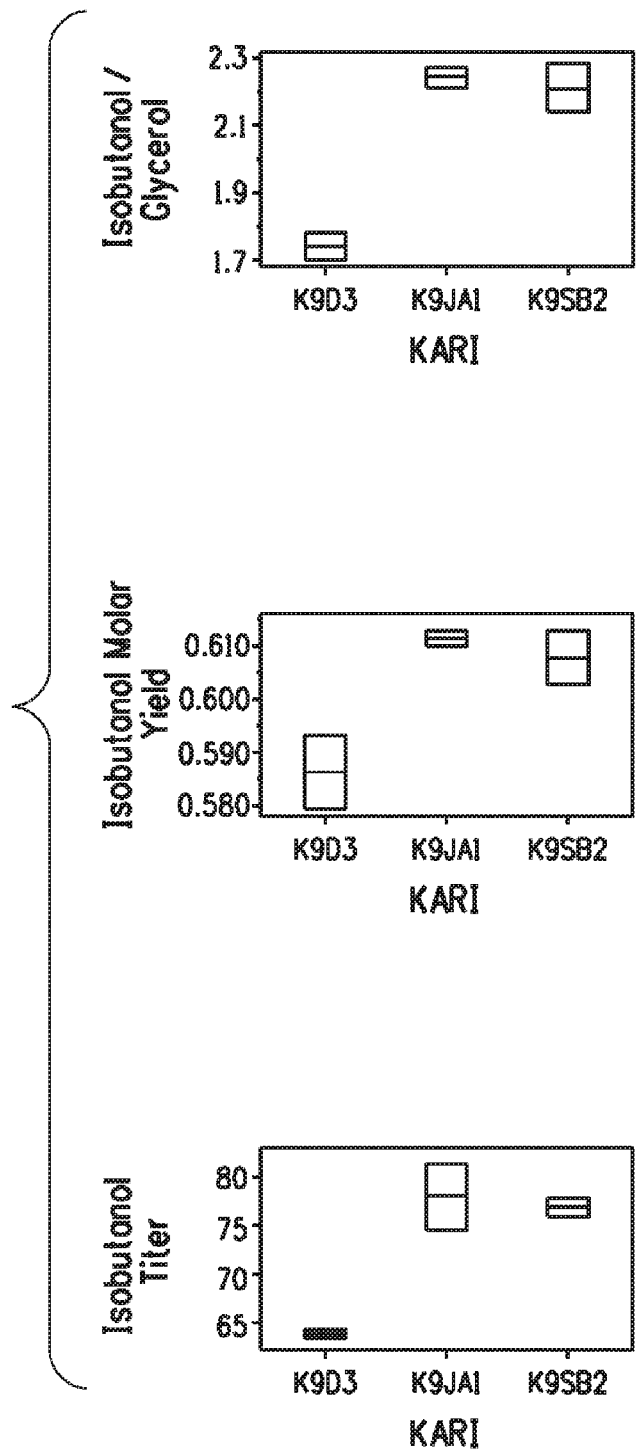
Figure 9C:
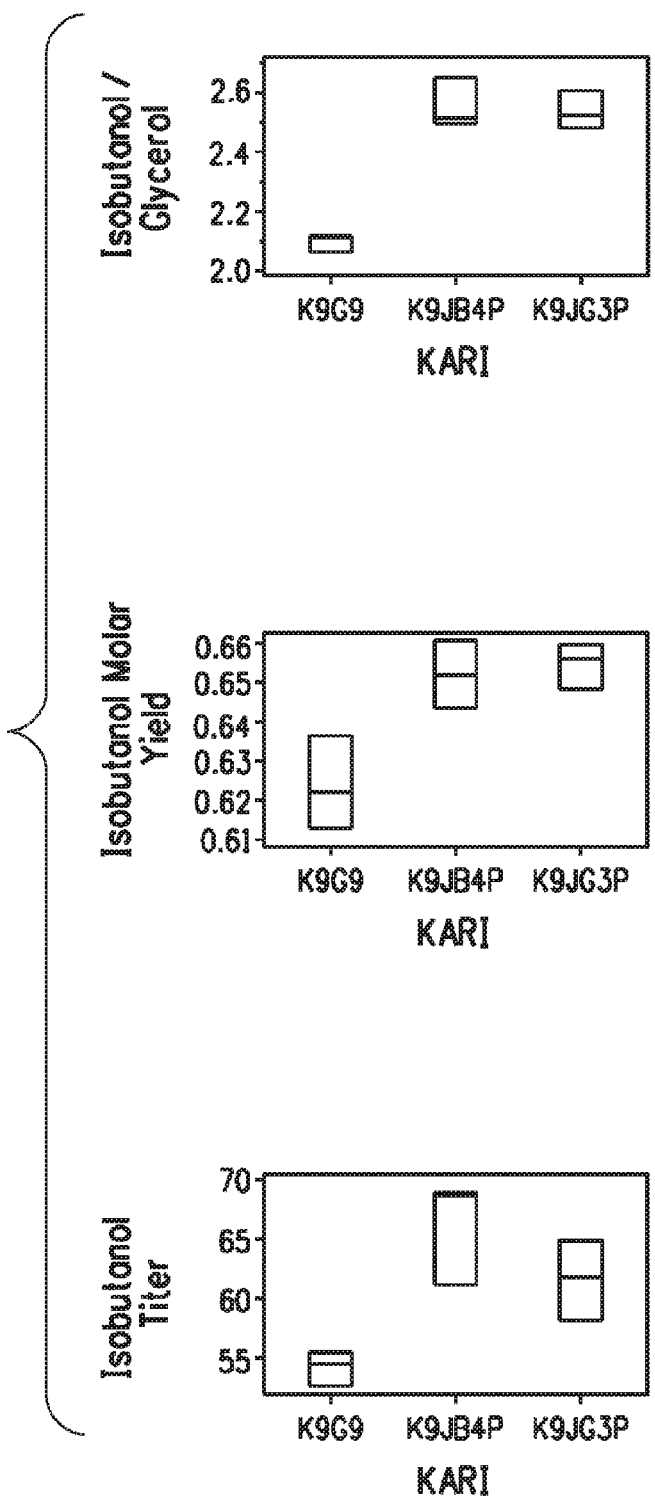

Molar yields for glycerol, isobutanol and the glycerol/isobutanol ratio were determined. Mean and standard deviations were calculated from triplicate analyses for each variant. Student's t-test was then employed to determine if the difference in the values was statistically significant from the K9D3 control values. For the new variants, the increases in $K_M$ values for NADPH relative to $K_M$ for NADH are expected result reduced NADPH utilization. Results reported in the Table below and in FIG. 9 indicate that the new variants with increased ratios of $K_M$ NADPH to $K_M$ NADH exhibit higher isobutanol to glycerol ratios relative to K9D3 and K9G9. K9SB2 demonstrated a 35% increase in isobutanol titer compared to K9D3.

TABLE 24

K9G9 Variants Kinetic and Isobutanol Data

| | Variant | $K_m$ (NADPH)/ $K_m$ (NADH) | Isobutanol/ Glycerol Ratio | Isobutanol Molar Yield | Isobutanol Titer, mM |
|---|---|---|---|---|---|
| Experiment 1 | K9D3 | 0.24 | 1.67 ± 0.02 | 0.581 ± 0.007 | 33.9 ± 1.8 |
| | K9JB4 | 2.2 | 2.10 ± 0.06 | 0.603 ± 0.006 | 35.3 ± 1.3 |
| | K9JG3 | 1.1 | 2.07 ± 0.06 | 0.598 ± 0.004 | 39.1 ± 1.6 |
| Experiment 2 | K9D3 | 0.24 | 1.75 ± 0.06 | 0.586 ± .0100 | 63.7 ± 0.6 |
| | K9JA1 | 4.5 | 2.24 ± 0.04 | 0.611 ± 0.002 | 78.2 ± 5.4 |
| | K9SB2 | 3.9 | 2.21 ± 0.10 | 0.608 ± 0.007 | 77.2 ± 1.4 |
| Experiment 3 | K9G9 | 0.31 | 2.10 ± 0.03 | 0.624 ± 0.011 | 54.2 ± 1.5 |
| | K9JG3P | 1.9 | 2.56 ± 0.08 | 0.652 ± 0.009 | 66.3 ± 4.0 |
| | K9JB4P | 2.4 | 2.54 ± 0.07 | 0.654 ± 0.006 | 61.5 ± 3.4 |

Example 20

Construction of K9SB2 Error Prone PCR Library

The K9SB2 error prone PCR library was constructed in a similar manner as the K9G9 library with the following modifications. The mutagenic PCR mixture consisted of 9.5 µl K9SB2 in a pBAD.KARI vector (190 ng/µl), 1.25 µl of primer K9G9_EZ_F1 (100 ng-µl), 1.25 µl of primer K9G9_EZ_R1 (100 ng/µl), 5 µl of 10× Mutazyme II reaction buffer, 1 µl of 40 mM dNTP mix, 1.5 µl of Mutazyme II DNA polymerase, and 30.5 µl of ddH2O. The "EZclone reaction" contained 25 µl of the 2×EZClone enzyme mix, 3 µl of megaprimer (K9SB2 mutagenic PCR product, 190 ng/µl), 2.6 µl of K9SB2 template DNA (19 ng/µl), 3 µl of EZClone solution 1, and 16 µl of ddH$_2$O. For the Dpn I step, the mixture was incubated for 3 hr at 37° C. Clones were employed for high throughput screening as described in Example 21.

Example 21

Screening for K9SB2 Variants with Further Increased Ratios of Km NADPH to Km NADPH Based on Increased NADH to NADPH Activity Ratios The K9SB2 library described in Example 20 was screened for variants with reduced NADPH affinity. With the specific objective to increase Km for NADPH relative to Km for NADH, the hits from the screen were partially purified and kinetic analyses were performed to determine $V_{max}$ and $K_m$ parameters with NADH and with NADPH.

High Throughput Screening Assay of K9SB2 Gene Library

Variants were screened using HTS as described in Example 16, with the following exceptions. Assays buffer consisted of 2.4 mM (R/S)-acetolactate, 100 mM HEPES pH 6.8, 10 mM $MgCl_2$, 150 μM NADH or 100 μM NADPH and 12.5 μL 0.5× cell lysate.

The ratio for the measured rate for oxidation of 100 μM NADPH to the measured rate for oxidation of 150 μM NADH was calculated for each variant and positive control well (2 per plate). A variant well was considered to contain an initial hit if the NADH rate was greater than 0.6 OD/hr and the rate ratio (NADPH/NADH) was less than 0.37 (three standard deviations lower than the positive control mean). A total of 218 hits were identified from a pool of 4947 potential variants. These initial hits were consolidated, forming a smaller library for further analysis.

The consolidated initial hit library was grown in biological triplicate and cell free extracts were prepared and assayed as described above. Rate ratios were then calculated for the variants and positive controls as above. Final hits that were selected for detailed kinetic analysis met the following criteria: the NADPH/NADH rate ratio was less than 0.45, the NADH rate was greater than 0.6 OD/hr and at least two out of three biological replicates passed the criteria. 107 variants were identified.

Data were also analyzed to identify variants that had a higher rate of conversion for S-acetolactate to DHIV with the NADH cofactor. The average rate and standard deviation of NADH oxidation was calculated for all the positive controls. A variant was considered a potential hit if the rate of NADH oxidation was at least 3 standard deviations higher than the rate of the positive control (2.524 OD/hr). 68 variants were identified and sequence analysis determined that 17 had at least one amino acid substitution. The substitutions T93A and T93I each appeared twice and variants 2017 B12 and D6 have been selected for further analysis.

DNA sequencing of the 107 variants identified from the secondary HTS screening was accomplished by using TempliPhi™ (GE Healthcare) with the primers pBAD-For (ATGCCATAGCATTTTTATCC; SEQ ID NO: 393) and pBAD-Rev (CTGATTTAATCTGTATCAGGCT; SEQ ID NO: 394). 105 sequences were different from the parent and the amino acid substitutions are listed in the first of the following two tables.

DNA sequencing of the 68 variants identified from the NADH rate screening was accomplished by using TempliPhi™ (GE Healthcare) with primers pBAD-For (ATGCCATAGCATTTTTATCC; SEQ ID NO: 393) and pBAD-Rev (CTGATTTAATCTGTATCAGGCT; SEQ ID NO: 394). 17 sequences were different form wild type and the amino acid substitutions of the 2 substitutions that appeared repeatedly are listed in the second table below.

TABLE 25

K9SB2 Variants' Amino Acid Substitutions

| Variant | Seq | Amino Acid Substitutions |
|---|---|---|
| K9SB2 | 427 | Y53F, S56A, K57E, S58E, N87P |
| 2011 A2 | 433 | Y53F, G55D, S56A, K57E, S58E, N87P |
| 2011 A3 | 434 | Y53F, S56A, K57E, S58E, N87P, M94I |
| 2011 A5 | 435 | Y53F, S56A, K57E, S58E, M83I, N87P, L185M, E217D |
| 2011 A7 | 436 | Y53F, S56A, K57E, S58E, N87P, D98V |
| 2011 A9 | 437 | Y53F, S56A, K57E, S58E, F67I, N87P |
| 2011 A11 | 438 | Y53F, S56A, K57E, S58E, N87P, M94T, K126E, T273A |
| 2011 B1 | 439 | Y53F, S56A, K57E, S58E, N87P, M94I, A279T |
| 2011 B2 | 440 | Y53F, S56A, K57E, S58E, N87P, Q91L |
| 2011 B3 | 441 | Y53L, S56A, K57E, S58E, N87P |
| 2011 B4 | 442 | Y53F, S56A, K57E, S58E, N87P, P135T |
| 2011 B7 | 443 | Y53F, S56A, K57E, S58E, N87P, L185M |
| 2011 B8 | 444 | Y53F, S56A, K57E, S58E, N87P, C233S, F296Y |
| 2011 B10 | 445 | Y53F, S56A, K57E, S58E, N87P, A303D |
| 2011 C1 | 446 | Y53F, S56A, K57E, S58E, E63K, N87P, G251D, K294R |
| 2011 C3 | 448 | Y53F, S56A, K57E, S58E, A72V, N87P, N102Y, F189I, Y245H |
| 2011 C6 | 449 | Y53F, S56A, K57E, S58E, I84F, N87P |
| 2011 C7 | 450 | E13V, Y53F, S56A, K57E, S58E, M94I, N87P, T141I |
| 2011 C8 | 451 | Y53F, S56A, K57E, S58E, A72V, N87P, N102Y, F189I, Y245H |
| 2011 C9 | 447 | Y53F, S56A, K57E, S58E, N87P, E194D |
| 2011 C10 | 452 | Y53F, A56G, K57E, S58E, K60N, N87P |
| 2011 C12 | 453 | Y53F, S56A, K57E, S58E, I84L, N87P, N97T |
| 2011 D1 | 454 | L39M, Y53F, S56A, K57E, S58E, E68G, N87P |
| 2011 D2 | 455 | Y53F, S56A, K57E, S58E, N87P, M94I, V307I |
| 2011 D3 | 456 | Y53F, S56A, K57E, S58E, F67I, N87P |
| 2011 D4 | 457 | Y53F, S56A, K57E, S58E, N87P, P135L, A202V |
| 2011 D5 | 458 | Y53F, S56A, K57E, S58E, N87P, G164S, G199A |
| 2011 D6 | 500 | Y53F, S56A, K57E, S58E, N87P, S247C |
| 2011 D8 | 459 | Y53F, S56A, K57E, S58E, N87P, N116I |
| 2011 D9 | 460 | Y53F, S56A, K57E, S58E, N87P, K90M |
| 2011 D11 | 461 | Y53F, S56A, K57E, S58E, N87P, M94L, T259I |
| 2011 D12 | 462 | Y53F, S56A, K57E, S58E, M83K, N87P |
| 2011 E3 | 463 | Y53F, S56A, K57E, S58E, N87P, I122V, L297W |
| 2011 E4 | 464 | Y53F, S56A, K57E, S58E, N87P, A112S, Q160R |
| 2011 E8 | 465 | Y53F, S56A, K57E, S58E, N87P, V142I, P320L |
| 2011 E11 | 466 | Y53F, S56A, K57E, S58E, N87P, Q91L |
| 2011 F2 | 467 | Y53F, S56V, K57E, S58E, N87P, A210T |
| 2011 F4 | 468 | Y53F, S56A, K57E, S58E, N87P, F189I |
| 2011 F6 | 469 | Y53F, S56G, K57E, S58E, K60N, N87P |
| 2011 F9 | 470 | A41V, Y53F, S56A, K57E, S58E, N87P, S305P |
| 2011 F10 | 471 | Y53F, S56A, K57E, S58E, L85M, N87P |
| 2011 G1 | 472 | E13V, Y53F, S56A, K57E, S58E, M94I, N87P, T141I |
| 2011 G3 | 473 | H35Q, Y53F, S56A, K57E, S58E, N87P |
| 2011 G4 | 474 | Y53F, S56A, K57E, S58E, I84F, N87P |
| 2011 G8 | 475 | A26T, Y53F, S56A, K57E, S58E, N87P, K90M |
| 2011 G9 | 476 | Y53F, S56T, K57E, S58E, N87P |
| 2011 G10 | 477 | Y53F, S56A, K57E, S58E, I84F, N87P |
| 2011 H1 | 478 | Y53F, S56A, K57E, S58E, N87P, M94I, V156L |
| 2011 H5 | 479 | Y53F, S56A, K57E, S58E, I84L, N87P |
| 2011 H7 | 480 | Y53F, S56T, K57E, S58E, N87P |
| 2011 H9 | 481 | Y53F, G55C, S56A, K57E, S58E, N87P |
| 2012 A2 | 482 | Y53F, S56A, K57E, S58E, R61G, I86V, N87P |
| 2012 A7 | 483 | Y53F, S56A, K57E, S58E, T71S, A76V, N87P |
| 2012 A8 | 484 | Y53F, S56A, K57E, S58E, N87P, M212T |
| 2012 A9 | 485 | H35Q, Y53F, S56A, K57E, S58E, A72T, N87P |
| 2012 A10 | 486 | A36T, Y53F, S56A, K57E, S58E, N87P |

TABLE 25-continued

K9SB2 Variants' Amino Acid Substitutions

| Variant | Seq | Amino Acid Substitutions |
|---|---|---|
| 2012 A11 | 487 | Y53F, S56A, K57E, S58E, N87P, S247T |
| 2012 B3 | 488 | Y53F, S56A, K57E, S58E, N87P, P135S |
| 2012 B4 | 489 | Y53F, S56A, K57E, S58E, W59R, N87P, K278E |
| 2012 B5 | 490 | Y53F, S56V, K57E, S58E, N87P, I234V |
| 2012 B6 | 491 | Y30H, Y53F, S56A, K57E, S58E, N87P |
| 2012 B9 | 492 | I50M, Y53F, S56A, K57E, S58E, N87P |
| 2012 C2 | 493 | Y53L, S56A, K57E, S58E, N87P |
| 2012 C3 | 494 | Y53F, S56A, K57E, S58E, N87P, F115V, T191S, V208I, C209W, F292I |
| 2012 C5 | 495 | Y53F, S56A, K57E, S58E, N87P, M94I |
| 2012 C6 | 496 | Y53F, S56A, K57E, S58E, F67L, N87P |
| 2012 C8 | 497 | Y53F, S56A, K57E, S58E, N87P, M94I, M169T |
| 2012 C10 | 498 | Y53F, S56A, K57E, S58E, F67I, N87P, T276I |
| 2012 D1 | 499 | Y53F, S56A, K57E, S58E, I84F, N87P, M132T |
| 2012 D8 | 501 | Y53F, S56A, K57E, S58E, N87P, P135S |
| 2012 D11 | 502 | K8N, Y53F, S56A, K57E, S58E, N87P, K90M, T141I |
| 2012 E5 | 503 | Y53F, S56A, K57E, S58E, I84L, N87P |
| 2012 E9 | 504 | Y53F, S56A, K57E, S58E, N87P, V142I, T191S, C233S |
| 2012 F1 | 505 | Y53F, S56A, K57E, S58E, N87P, H235Y |
| 2012 F2 | 506 | Y53F, S56V, K57E, S58E, N87P, V232D |
| 2012 F3 | 507 | Y53F, S56A, K57E, S58E, N87P, K90M, V142I, T187S |
| 2012 F4 | 508 | Y53F, S56A, K57E, S58E, N87P, M94I, G149D |
| 2012 F7 | 509 | E13V, Y53F, S56A, K57E, S58E, N87P, M94I, T141I |
| 2012 F10 | 510 | Y53F, S56A, K57E, S58E, Q65H, N87P, F189I |
| 2012 F12 | 511 | Y53F, S56V, K57E, S58E, N87P |
| 2012 G3 | 512 | Y53F, S56T, K57E, S58E, N87P, R190S |
| 2012 G4 | 513 | Y53F, S56A, K57E, S58E, N87P, N102S, V142I |
| 2012 G5 | 514 | Y53F, S56A, K57E, S58E, I84L, N87P |
| 2012 G8 | 515 | Y53F, S56A, K57E, S58E, K77N, N87P, A92V |
| 2012 G9 | 516 | Y53F, S56A, K57E, S58E, N87P, M94I, V307I |
| 2012 G10 | 517 | Y53F, S56A, K57E, S58E, N87P, T195I |
| 2012 G12 | 518 | Y53F, S56A, K57E, S58E, N87P, F309I |
| 2012 H1 | 519 | Y53F, S56A, K57E, S58E, N87P, K90T, A180S |
| 2012 H3 | 520 | Y53F, S56A, K57E, S58E, W59C, N87P |
| 2012 H7 | 521 | Y53F, S56A, K57E, S58E, N87P, M94I, A202T |
| 2012 H9 | 522 | H35N, Y53F, S56A, K57E, S58E, N87P |
| 2012 H11 | 523 | Y53F, S56A, K57E, S58E, A72V, N87P, L211M, I240M |
| 2013 A2 | 524 | Y53F, S56T, K57E, S58E, N87P, Q288H |
| 2013 A4 | 525 | Y53F, S56A, K57E, S58E, L85M, N87P |
| 2013 A5 | 526 | L52S, Y53F, S56A, K57E, S58E, N87P |
| 2013 B3 | 527 | A36T, Y53F, S56A, K57E, S58E, N87P, V203I |
| 2013 B5 | 528 | Y53F, S56A, K57E, S58E, N87P, P135T |
| 2013 B7 | 529 | I9M, Y53F, S56A, K57E, S58E, N87P, K90E |
| 2013 B8 | 530 | Y53F, G55C, S56A, K57E, S58E, N87P |
| 2013 B9 | 531 | Y53F, S56V, K57E, S58E, N87P |
| 2013 B11 | 532 | A38V, Y53F, S56A, K57E, S58E, N87P |
| 2013 C1 | 533 | Y53L, S56A, K57E, S58E, N87P, M237I |
| 2013 C6 | 534 | K23M, Y53F, S56A, K57E, S58E, N87P, E194D |
| 2013 C8 | 535 | Y53F, S56A, K57E, S58E, N87P, P135T |
| 2013 C12 | 536 | Y53F, S56A, K57E, S58E, A72V, N87P, T93S, A176V, H235Y |
| 2013 D1 | 537 | Y53F, S56A, K57E, S58E, N87P, M94R, K310M |

TABLE 26

K9SB2 Variants' Amino Acid Substitutions

| Variant | AA Seq ID NO; Nucleic acid SEQ ID NO | Amino Acid Substitutions |
|---|---|---|
| K9SB2 | 427 | Y53F, S56A, K57E, S58E, N87P |
| 2017 B12 | 639; 640 | Y53F, S56A, K57E, S58E, N87P, T93I |
| 2017 D6 | 641; 642 | Y53F, S56A, K57E, S58E, N87P, T93A |

Kinetic Analysis of Partially Purified K9SB2 Variant Proteins

*E. coli* strain Bw25113 (ΔilvC), as described in U.S. Pat. No. 8,129,162, was used to express the 107 variants from the secondary HTS screening and positive control K9SB2. Clones from archive plates were inoculated into the 96-deep well plates. Each well contained 3.0 μl of cells from thawed archive plates, 200 μl of the LB medium containing 100 μg/ml ampicillin and 0.02% (w/v) arabinose as the inducer. Cells were the grown overnight at 37° C. with 80% humidity while shaking (900 rpm), harvested by centrifugation (4000 rpm, 7 min at 4° C.) (75004251, Thermo Scientific, Rockford, Ill.) and the cell pellet was stored at −80° C. for later analysis.

Frozen cell pellets in deep-well plates were thawed at room temperature for 30 minutes at the same time. 75 μl of 50% BugBuster (Novagen 71456, Darmstadt, Germany) (v/v in water) was added to each and cells were suspended using a plate shaker. The cells suspension in 50% Bug Buster was incubated for 30 minutes at room temperature which was then followed by a 15 minute incubation at 60° C. Cell debris and denatured heat labile proteins were pelleted by centrifugation (4000 rpm, 15 min at 4° C.) (75004251, Thermo Scientific, Rockford, Ill.) and 75 μL of the supernatant was transferred to a flat bottomed 96-well plate (Corning, 3370, Corning, N.Y.) and diluted two-fold with 75 μL 100 mM HEPES (pH 6.8), 100 mM KCl, 10 mM MgCl$_2$.

Total protein was determined by using the Bradford Assay with Coomaisse Plus (Thermo Scientific, #23238, Rockford, Ill.). BSA was employed as the standard. The concentration of protein was measured by determining the absorbance at 595 nm using a Cary 300 spectrophotometer (Agilent Technologies, Wilmington, Del.).

To determine $V_{max}$, and $K_M$ values for NADH and NADPH, the partially purified proteins were assayed at various concentrations of NADH (20, 30, 40, 60, 80, 120, 200 and 300 μM) and NADPH (60, 80, 120, 200, 300 and 400 μM). Assays were conducted at 30° C. in 100 mM HEPES (pH 6.8), 10 mM MgCl$_2$, 100 mM KCl and 4.8 mM R/S-acetolactate. Between 0.005 to 0.015 mg/mL total protein was added to the assay. The rate of conversion of S-acetolactate to DHIV was measured via monitoring the oxidation of NAD(P)H at 340 nm using a Spectramax 384 Plus plate reader (Molecular Devices, Sunnyvale, Calif.). The activity was calculated using the molar extinction coefficient of 6220 M$^{-1}$cm$^{-1}$. $V_{max}$ and $K_m$ values were calculated by plotting specific activity (U/mg) vs. cofactor concentration and the data were fit to the Michaelis-Menten equation using Kaleidagraph software (Synergy, Reading, Pa.).

TABLE 27

Kinetic Values for Partially Purified K9SB2 Variants as Determined via NAD(P)H Consumption Assays

| Variant | $V_{max}$ NADPH, U/mg | $K_m$ NADPH, μM | $V_{max}/K_m$ NADPH, L/min * mg | $V_{max}$ NADH, U/mg | $K_m$ NADH, μM | $V_{max}/K_m$ NADH, L/min * mg |
|---|---|---|---|---|---|---|
| K9SB2 | 1.79 | 153 | 0.012 | 2.10 | 87.4 | 0.024 |
| 2011 A2 | 1.48 | 897 | 0.002 | 1.94 | 71.2 | 0.027 |
| 2011 A3 | 1.43 | 371 | 0.004 | 1.33 | 44.1 | 0.030 |

TABLE 27-continued

Kinetic Values for Partially Purified K9SB2 Variants as Determined via NAD(P)H Consumption Assays

| Variant | $V_{max}$ NADPH, U/mg | $K_m$ NADPH, μM | $V_{max}/K_m$ NADPH, L/min * mg | $V_{max}$ NADH, U/mg | $K_m$ NADH, μM | $V_{max}/K_m$ NADH, L/min * mg |
|---|---|---|---|---|---|---|
| 2011 A5 | 0.93 | 109 | 0.009 | 0.23 | 17.4 | 0.017 |
| 2011 A7 | 2.27 | 334 | 0.007 | 1.70 | 69.2 | 0.025 |
| 2011 A9 | 2.09 | 266 | 0.008 | 0.40 | n/d | n/a |
| 2011 A11 | 2.21 | 294 | 0.008 | 1.25 | 25.8 | 0.048 |
| 2011 B1 | 1.79 | 421 | 0.004 | 64.5 | 55171 | 0.001 |
| 2011 B2 | 0.33 | 254 | 0.001 | 0.02 | 264 | 0.007 |
| 2011 B3 | 1.87 | 505 | 0.004 | 0.68 | 225 | 0.003 |
| 2011 B4 | 0.36 | 294 | 0.001 | 0.26 | 171 | 0.002 |
| 2011 B7 | n/d | 1.03 | n/a | 0.48 | 25.5 | 0.019 |
| 2011 B8 | 0.83 | 109.5 | 0.008 | 0.61 | 28.7 | 0.021 |
| 2011 B10 | 0.88 | 171 | 0.005 | 0.46 | 7.53 | 0.061 |
| 2011 C1 | 1.06 | 404 | 0.003 | 1.51 | 191 | 0.008 |
| 2011 C3 | 1.08 | 844 | 0.001 | 2.53 | 500 | 0.005 |
| 2011 C6 | 1.19 | 388 | 0.003 | 1.90 | 189 | 0.010 |
| 2011 C7 | 0.71 | 946 | 0.001 | 1.95 | 457 | 0.004 |
| 2011 C8 | 1.73 | 1546 | 0.001 | 3.73 | 750 | 0.005 |
| 2011 C9 | 1.02 | 123 | 0.008 | 2.29 | 177 | 0.013 |
| 2011 C10 | 1.02 | 656 | 0.002 | 3.84 | 899 | 0.004 |
| 2011 C12 | 2.74 | 244 | 0.011 | 3.08 | 99 | 0.031 |
| 2011 D1 | 4.68 | 501 | 0.009 | 3.54 | 80.4 | 0.044 |
| 2011 D2 | 2.34 | 547 | 0.004 | 2.18 | 77.3 | 0.028 |
| 2011 D3 | 0.05 | 306 | 0.0002 | 0.05 | 44.3 | 0.001 |
| 2011 D4 | 0.47 | 857 | 0.001 | 0.44 | 91.6 | 0.005 |
| 2011 D5 | 0.75 | 550 | 0.001 | 0.42 | 57.1 | 0.007 |
| 2011 D6 | 0.70 | 200 | 0.004 | 0.52 | 25.11 | 0.021 |
| 2011 D8 | 0.04 | 214 | 0.0002 | 0.04 | 38.9 | 0.001 |
| 2011 D9 | 0.18 | 407 | 0.0004 | 0.16 | 50.2 | 0.003 |
| 2011 D11 | 0.78 | 185 | 0.004 | 0.61 | 15.0 | 0.041 |
| 2011 D12 | 0.74 | 190 | 0.004 | 0.80 | 39.0 | 0.021 |
| 2011 E3 | 0.77 | 163 | 0.005 | 1.54 | 128 | 0.012 |
| 2011 E4 | 1.59 | 270 | 0.006 | 3.78 | 234 | 0.016 |
| 2011 E8 | 0.91 | 435 | 0.002 | 2.16 | 252 | 0.009 |
| 2011 E11 | 5.56 | 6466 | 0.001 | 3.06 | 511 | 0.006 |
| 2011 F2 | 0.39 | 692 | 0.001 | 1.79 | 136 | 0.013 |
| 2011 F4 | 2.07 | 242 | 0.009 | 2.00 | 68.3 | 0.029 |
| 2011 F6 | 1.19 | 946 | 0.001 | 1.35 | 231 | 0.006 |
| 2011 F9 | 0.57 | 269 | 0.002 | 0.45 | 27.1 | 0.017 |
| 2011 F10 | 1.43 | 390 | 0.004 | 1.55 | 79.8 | 0.019 |
| 2011 G1 | 1.31 | 1533 | 0.001 | 0.50 | 40.1 | 0.013 |
| 2011 G3 | 0.61 | 1003 | 0.001 | 1.00 | 283 | 0.004 |
| 2011 G4 | 1.00 | 316 | 0.003 | 2.13 | 174 | 0.012 |
| 2011 G8 | 0.90 | 482 | 0.002 | 1.22 | 106 | 0.012 |
| 2011 G9 | 0.30 | 530 | 0.001 | 3.48 | 549 | 0.006 |
| 2011 G10 | 0.93 | 358 | 0.003 | 2.13 | 238 | 0.009 |
| 2011 H1 | 0.96 | 218 | 0.004 | 1.57 | 114 | 0.014 |
| 2011 H5 | 1.17 | 81.2 | 0.014 | 1.85 | 86.5 | 0.022 |
| 2011 H7 | 0.20 | 435 | 0.001 | 1.25 | 173 | 0.007 |
| 2011 H9 | 1.30 | 741 | 0.002 | 1.55 | 177 | 0.009 |
| 2012 A2 | 1.71 | 264 | 0.007 | 1.58 | 55.4 | 0.029 |
| 2012 A7 | 1.98 | 215 | 0.009 | 1.87 | 67.3 | 0.028 |
| 2012 A8 | 1.19 | 91.8 | 0.013 | 1.24 | 22.7 | 0.055 |
| 2012 A9 | 0.44 | 481 | 0.001 | 0.34 | 38.1 | 0.009 |
| 2012 A10 | 1.21 | 340 | 0.004 | 1.31 | 66.7 | 0.020 |
| 2012 A11 | 1.99 | 342 | 0.006 | 1.37 | 35.9 | 0.038 |
| 2012 B3 | 0.88 | 1214 | 0.001 | 0.42 | 63.8 | 0.007 |
| 2012 B4 | 4.34 | 1593 | 0.003 | 1.66 | 95.1 | 0.018 |
| 2012 B5 | 4.88 | 7389 | 0.001 | 1.19 | 85.2 | 0.014 |
| 2012 B6 | 3.72 | 428 | 0.009 | 2.23 | 51.3 | 0.044 |
| 2012 B9 | 1.17 | 523 | 0.002 | 0.87 | 63.7 | 0.014 |
| 2012 C2 | 4.43 | 923 | 0.005 | 3.16 | 189 | 0.017 |
| 2012 C3 | 1.40 | 203 | 0.007 | 1.80 | 68.9 | 0.026 |
| 2012 C5 | 1.73 | 348 | 0.005 | 3.66 | 268 | 0.014 |
| 2012 C6 | 2.18 | 234 | 0.009 | 2.90 | 103 | 0.028 |
| 2012 C8 | 1.53 | 394 | 0.004 | 2.63 | 194 | 0.014 |
| 2012 C10 | 1.12 | 286 | 0.004 | 1.41 | 78.9 | 0.018 |
| 2012 D1 | 0.72 | 599 | 0.001 | 0.58 | 64.5 | 0.009 |
| 2012 D8 | 1.17 | 1528 | 0.001 | 0.47 | 73.6 | 0.006 |
| 2012 D11 | 0.43 | 334 | 0.001 | 0.52 | 27.7 | 0.019 |
| 2012 E5 | 2.13 | 257 | 0.008 | 4.77 | 313 | 0.015 |
| 2012 E9 | 1.07 | 1326 | 0.001 | n/d | n/d | n/a |
| 2012 F1 | 1.70 | 272 | 0.006 | 1.48 | 62.5 | 0.024 |
| 2012 F2 | 0.39 | 925 | 0.0004 | 0.79 | 97.8 | 0.008 |
| 2012 F3 | 1.40 | 2213 | 0.0006 | 0.94 | 142 | 0.007 |

TABLE 27-continued

Kinetic Values for Partially Purified K9SB2 Variants as Determined via NAD(P)H Consumption Assays

| Variant | $V_{max}$ NADPH, U/mg | $K_m$ NADPH, µM | $V_{max}/K_m$ NADPH, L/min * mg | $V_{max}$ NADH, U/mg | $K_m$ NADH, µM | $V_{max}/K_m$ NADH, L/min * mg |
|---|---|---|---|---|---|---|
| 2012 F4 | 2.70 | 719 | 0.004 | 1.50 | 72.9 | 0.021 |
| 2012 F7 | 0.86 | 840 | 0.001 | 0.77 | 117 | 0.007 |
| 2012 F10 | 1.92 | 170 | 0.011 | 1.75 | 27.4 | 0.064 |
| 2012 F12 | 0.90 | 1582 | 0.0006 | 1.75 | 117 | 0.015 |
| 2012 G3 | 1.47 | 1003 | 0.002 | 1.07 | 127 | 0.008 |
| 2012 G4 | 0.73 | 615 | 0.001 | 0.63 | 81.6 | 0.007 |
| 2012 G5 | 1.92 | 240 | 0.008 | 2.00 | 83.5 | 0.024 |
| 2012 G8 | 1.17 | 315 | 0.004 | 0.99 | 58.7 | 0.017 |
| 2012 G9 | 2.41 | 717 | 0.003 | 1.37 | 91.5 | 0.015 |
| 2012 G10 | 1.06 | 400 | 0.003 | 0.71 | 39.8 | 0.018 |
| 2012 G12 | 1.58 | 147 | 0.011 | 2.00 | 70.0 | 0.029 |
| 2012 H1 | 1.49 | 195 | 0.008 | 1.74 | 68.9 | 0.025 |
| 2012 H3 | 14.98 | 7389 | 0.002 | 1.45 | 99.0 | 0.015 |
| 2012 H7 | 1.14 | 246 | 0.005 | 1.30 | 76.2 | 0.017 |
| 2012 H9 | 0.37 | 210 | 0.002 | n/d | n/d | n/a |
| 2012 H11 | 0.65 | 162 | 0.004 | 0.62 | 32.0 | 0.019 |
| 2013 A2 | 0.58 | 285 | 0.002 | 0.64 | 71.0 | 0.009 |
| 2013 A4 | 0.63 | 188 | 0.003 | 0.86 | 81.5 | 0.011 |
| 2013 A5 | 0.61 | 886 | 0.001 | 0.88 | 210 | 0.004 |
| 2013 B2 | 0.62 | 282 | 0.002 | 0.71 | 70.4 | 0.010 |
| 2013 B5 | 6.68 | 7389 | 0.001 | 0.083 | 150 | 0.006 |
| 2013 B7 | 1.22 | 433 | 0.003 | 1.12 | 79.0 | 0.014 |
| 2013 B8 | 0.42 | 90.7 | 0.005 | 1.27 | 191 | 0.007 |
| 2013 B9 | 5.31 | 13970 | 0.0004 | 1.38 | 217 | 0.006 |
| 2013 B11 | 0.48 | 212 | 0.002 | 0.60 | 63.2 | 0.010 |
| 2013 C1 | 0.49 | 149 | 0.003 | 0.68 | 64.8 | 0.0105 |
| 2013 C6 | 0.54 | 163 | 0.003 | 0.36 | 24.4 | 0.015 |
| 2013 C8 | 2.87 | 3752 | 0.001 | 0.70 | 188 | 0.004 |
| 2013 C12 | 0.75 | 495 | 0.002 | 0.79 | 115 | 0.007 |
| 2013 D1 | 1.31 | 1608 | 0.001 | 0.87 | 188 | 0.005 |

Example 22

Construction of Strain PNY2259

The purpose of this example is to describe the assembly of the constructs used to replace the chromosomal copy of kivD_LI(y) in PNY2238 at the adh1Δ locus with kivD_Lg(y).

The deletion/integration was created by homologous recombination with PCR products containing regions of homology upstream and downstream of the target region and the URA3 gene for selection of transformants. The URA3 gene was removed by homologous recombination to create a starless deletion/integration. The plasmid to integrate kivD_Lg(y) was derived from a plasmid constructed to integrate UAS(PGK1)P[FBA1]-kivD_LI(y) into the ADH1 locus of *Saccharomyces cerevisiae*. Construction of the plasmid used to integrate UAS(PGK1)P[FBA1]-kivD_LI(y) into the ADH1 locus is described below. The plasmids were constructed in pUC19-URA3MCS.

Construction of the ADH1 Deletion/UAS(PGK1)P[FBA1]-kivD_LI(y) Integration Plasmid The kivD coding region from *Lactococcus lactis* codon optimized for expression in *Saccharomyces cerevisiae*, kivD_LI(y), was amplified using pLH468 (SEQ ID NO: 139) as template with primer oBP562 (SEQ ID NO: 197), containing a PmeI restriction site, and primer oBP563 (SEQ ID NO: 198), containing a 5' tail with homology to the 5' end of ADH1 Fragment B. ADH1 Fragment B was amplified from *Saccharomyces cerevisiae* CEN.PK 113-7D genomic DNA with primer oBP564 (SEQ ID NO: 199), containing a 5' tail with homology to the 3' end of kivD_LI(y), and primer oBP565 (SEQ ID NO: 200), containing a FseI restriction site. PCR products were purified with a PCR Purification kit (Qiagen; Valencia, Calif.). kivD_LI(y)-ADH1 Fragment B was created by overlapping PCR by mixing the kivD_LI (y) and ADH1 Fragment B PCR products and amplifying with primers oBP562 (SEQ ID NO: 197) and oBP565 (SEQ ID NO: 200). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 201), containing a SacI restriction site, and primer oBP506 (SEQ ID NO: 202), containing an AscI restriction site. The ADH1 Fragment A PCR product was digested with SacI and AscI and ligated with T4 DNA ligase into the corresponding sites of the plasmid containing kivD_LI(y)-ADH1 Fragment B. ADH1 Fragment C was amplified from genomic DNA with primer oBP507 (SEQ ID NO: 203), containing a PacI restriction site, and primer oBP508 (SEQ ID NO: 204), containing a SalI restriction site. The ADH1 Fragment C PCR product was digested with PacI and SalI and ligated with T4 DNA ligase into the corresponding sites of the plasmid containing ADH1 Fragment A-kivD_LI(y)-ADH1 Fragment B. The hybrid promoter UAS(PGK1)-$P_{FBA1}$ (SEQ ID NO: 406) was amplified from vector pRS316-UAS(PGK1)-$P_{FBA1}$-GUS with primer oBP674 (SEQ ID NO: 205), containing an AscI restriction site, and primer oBP675 (SEQ ID NO: 206), containing a PmeI restriction site. The UAS(PGK1)-$P_{FBA1}$ PCR product was digested with AscI and PmeI and ligated with T4 DNA ligase into the corresponding sites of the plasmid containing kivD_LI(y)-ADH1 Fragments ABC to generate pBP1181.

Construction of pBP1716 and pBP1719 kivD_LI(y) was removed from the ADH1 deletion/UAS(PGK1)P[FBA1]-kivD_LI(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 407), containing a PmeI restriction site, and primer oBP484 (SEQ ID NO: 408), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_LI(y) was cloned into the resulting vector for the targeted deletion of kivD_LI(y) in PNY1528. The fragment was amplified from pBP1181 with primers oBP822 (SEQ ID NO: 409), containing a NotI restriction site, and oBP823 (SEQ ID NO: 410), containing a PacI restriction site. The fragment was digested with NotI and PacI and ligated with T4 DNA ligase into the corresponding sites downstream of URA3 in the above plasmid with the kivD_LI(y) deletion after digestion with the appropriate restriction enzymes. The resulting plasmid was designated pBP1716.

The kivD coding region from *Listeria* grayi codon optimized for expression in *Saccharomyces cerevisiae* (SEQ ID NO: 411), kivD_Lg(y), was synthesized by DNA2.0 (Menlo Park, Calif.). kivD_Lg(y) was amplified with primers oBP828 (SEQ ID NO: 412), containing a PmeI restriction site, and oBP829 (SEQ ID NO: 413) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 414) and oBP829 (SEQ ID NO: 413). An isolate with kivD_Lg(y) in the correct orientation was designated pBP1719.

Construction of Strain PNY2259

The kivD_LI(y) deletion/kivD_Lg(y) integration cassette was amplified from pBP1719 with primers oBP505 (SEQ ID NO: 201) and oBP823 (SEQ ID NO: 410). Competent cells of the PNY2238 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30 C. Transformant strains were screened by PCR (JumpStart™ REDTaq (c) ReadyMix™) using primers Ura3-end F (SEQ ID NO: 222) and HY-50 (SEQ ID NO: 415). Transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_LI(y) and integration of kivD_Lg(y) was confirmed by PCR with primers HY-50 and oBP834 (SEQ ID NO: 416). One correct isolate contained kivD_Lg(y) at the same locus and expressed from the same promoter as kivD_LI(y) in PNY2238 was designated PNY2259.

Example 23

Construction of Two Site-Saturation Gene Libraries to Identify Variants with Cofactor Preference to NADH In Example 4, primers having the degeneracy codon NNK were used (N represents all 4 nucleotides A, C G and T while K stands for G and T). In this Example, primer mixtures containing primers encoding each individual amino acid change of A, C, D, E, F, G, H, I, L, M, N, P, Q, V, W, or Y for positions 53, 56 and 58 of K9 KARI were employed and substitutions to S, T, K, and R were excluded as non-preferred for these positions. The size of the saturation library targeting the three NADPH phosphate binding sites (53, 56 and 58) of K9 KARI is 4,096 (as compared to 32*32*32 or 32,768 variants using NNK degeneracy code primers as in Example 4).

One library construction method started from position 58. Primer mixtures were first made by mixing all the primers targeting the same positions (for example, the primer mixture, K9_53f, was made by mixing equal mole of all 16 forward primers targeting position 53 (listed in the table below). Similarly, K9_56f and K9_58f were prepared. The shared reverse primer is K9_191G_112210r (SEQ ID NO: 174): GGTTTCAGTTTCGCCTCTGAAGGTAGTTTC (called SR in this example). The mutation at position 58 was first introduced into AS6F1 through PCR. The mutagenesis procedure is similar to the one described in Example 4. In brief, K9_58f and SR were phosphorylated. The phosphorylated primers were then directly used to introduce mutation at position 58 into AS6F1 using USB Change_It kit (USB Corporation, Cleveland, Ohio, #78480). The template was removed with Dpn I. The cleaned up PCR product (Zymo DNA Clean & Concentrator-5; Zymo Research Corporation, Irvine, Calif., Cat #D4003) was transformed into KOBW-3a cells. After overnight growth on LB agar plates at a 37° C. incubator, all cells were collected and DNA was extracted using the Qiaprep Spin miniprep kit (Qiagen Inc. Valencia, Calif., Cat #27106)

The extracted DNA was then used as templates to introduce mutation at position 56 using K9_56f and SR same as the mutagenesis for position 58. At last the mutation at position 53 was similarly introduced. After mutations at all three positions (53, 56 and 58) were introduced into AS6F1, the new library was screened same as the one described in example 4 and some selected mutants are listed in the table below.

The other method began with the position 53. The primer mixtures K9_56r and K9_58r were similarly prepared using primers listed in the table below). The shared forward primer is pBAD_266f: CTCTCTACTGTTTCTCCATACCCG (SEQ ID NO: 634; called SF in this example). The mutation at position 53 was first introduced into AS6F1 through PCR. The mutagenesis procedure is similar to the one described above using AS6F1 as the template and K9_53f and SR as the two PCR primers. The resulted mutated DNA (at position 53) was used as templates and K9_56r and SF were used as the mutagenesis primers to introduced mutation at position 56. At last the mutation at position 58 was similarly introduced using K9_58r and SF. After mutations at all three positions (53, 56 and 58) were introduced into AS6F1, the new library was screened same as above and some selected mutants were listed in the table below.

TABLE 28 forward mutational primers.

| Targeted position(s) of K9-KARI | Primers | | |
|---|---|---|---|
| 53 | K9_53F_031411f | GTTATCATCGGATTATTCGAAGGA | (SEQ ID NO: 544) |
| | K9_53L_031411f | GTTATCATCGGATTATTGGAAGGA | (SEQ ID NO: 545) |
| | K9_53Y_031411f | GTTATCATCGGATTATATGAAGGA | (SEQ ID NO: 546) |
| | K9_53C_031411f | GTTATCATCGGATTATGTGAAGGA | (SEQ ID NO: 547) |
| | K9_53W_031411f | GTTATCATCGGATTATGGGAAGGA | (SEQ ID NO: 548) |
| | K9_53P_031411f | GTTATCATCGGATTACCAGAAGGA | (SEQ ID NO: 549) |
| | K9_53H_031411f | GTTATCATCGGATTACATGAAGGA | (SEQ ID NO: 550) |
| | K9_53Q_031411f | GTTATCATCGGATTACAAGAAGGA | (SEQ ID NO: 551) |
| | K9_53I_031411f | GTTATCATCGGATTAATTGAAGGA | (SEQ ID NO: 552) |
| | K9_53M_031411f | GTTATCATCGGATTAATGGAAGGA | (SEQ ID NO: 553) |
| | K9_53N_031411f | GTTATCATCGGATTAAATGAAGGA | (SEQ ID NO: 554) |
| | K9_53V_031411f | GTTATCATCGGATTAGTTGAAGGA | (SEQ ID NO: 555) |
| | K9_53A_031411f | GTTATCATCGGATTAGCTGAAGGA | (SEQ ID NO: 556) |
| | K9_53D_031411f | GTTATCATCGGATTAGATGAAGGA | (SEQ ID NO: 557) |
| | K9_53E_031411f | GTTATCATCGGATTAGAAGAAGGA | (SEQ ID NO: 558) |
| | K9_53G_031411f | GTTATCATCGGATTAGGTGAAGGA | (SEQ ID NO: 559) |
| 56 | K9_56F_031411f | GGATTACCTGAAGGATTCAAA | (SEQ ID NO: 560) |
| | K9_56L_031411f | GGATTACCTGAAGGATTGAAA | (SEQ ID NO: 561) |
| | K9_56Y_031411f | GGATTACCTGAAGGATATAAA | (SEQ ID NO: 562) |
| | K9_56C_031411f | GGATTACCTGAAGGATGTAAA | (SEQ ID NO: 563) |
| | K9_56W_031411f | GGATTACCTGAAGGATGGAAA | (SEQ ID NO: 564) |
| | K9_56P_031411f | GGATTACCTGAAGGACCAAAA | (SEQ ID NO: 565) |
| | K9_56H_031411f | GGATTACCTGAAGGACATAAA | (SEQ ID NO: 566) |
| | K9_56Q_031411f | GGATTACCTGAAGGACAAAAA | (SEQ ID NO: 567) |
| | K9_56I_031411f | GGATTACCTGAAGGAATTAAA | (SEQ ID NO: 568) |
| | K9_56M_031411f | GGATTACCTGAAGGAATGAAA | (SEQ ID NO: 569) |
| | K9_56N_031411f | GGATTACCTGAAGGAAATAAA | (SEQ ID NO: 570) |
| | K9_56V_031411f | GGATTACCTGAAGGAGTTAAA | (SEQ ID NO: 571) |
| | K9_56A_031411f | GGATTACCTGAAGGAGCTAAA | (SEQ ID NO: 572) |
| | K9_56D_031411f | GGATTACCTGAAGGAGATAAA | (SEQ ID NO: 573) |
| | K9_56E_031411f | GGATTACCTGAAGGAGAAAAA | (SEQ ID NO: 574) |
| | K9_56G_031411f | GGATTACCTGAAGGAGGTAAA | (SEQ ID NO: 575) |
| 58 | K9_58F_051611f | GATTACCTGAAGGATTTAAATTCTGGAAGAGAGC | (SEQ ID NO: 576) |
| | K9_58L_051611f | GATTACCTGAAGGATTTAAATTGTGGAAGAGAGC | (SEQ ID NO: 577) |
| | K9_58Y_051611f | GATTACCTGAAGGATTTAAATATTGGAAGAGAGC | (SEQ ID NO: 578) |
| | K9_58C_051611f | GATTACCTGAAGGATTTAAATGTTGGAAGAGAGC | (SEQ ID NO: 579) |
| | K9_58W_051611f | GATTACCTGAAGGATTTAAATGGTGGAAGAGAGC | (SEQ ID NO: 580) |

TABLE 28-continued forward mutational primers.

| Targeted position(s) of K9-KARI | Primers | | |
|---|---|---|---|
| | K9_58P_051611f | GATTACCTGAAGGATTTAAACCATGGAAGAGAGC | (SEQ ID NO: 581) |
| | K9_58H_051611f | GATTACCTGAAGGATTTAAACATTGGAAGAGAGC | (SEQ ID NO: 582) |
| | K9_58Q_051611f | GATTACCTGAAGGATTTALACAATGGAAGAGAGC | (SEQ ID NO: 583) |
| | K9_58I_051611f | GATTACCTGAAGGATTTAAAATTTGGAAGAGAGC | (SEQ ID NO: 584) |
| | K9_58M_051611f | GATTACCTGAAGGATTTAAAATGTGGAAGAGAGC | (SEQ ID NO: 585) |
| | K9_58N_051611f | GATTACCTGAAGGATTTAAAAATTGGAAGAGAGC | (SEQ ID NO: 586) |
| | K9_58V_051611f | GATTACCTGAAGGATTTAAAGTTTGGAAGAGAGC | (SEQ ID NO: 587) |
| | K9_58A_051611f | GATTACCTGAAGGATTTAAAGCTTGGAAGAGAGC | (SEQ ID NO: 588) |
| | K9_58D_051611f | GATTACCTGAAGGATTTAAAGATTGGAAGAGAGC | (SEQ ID NO: 589) |
| | K9_58E_051611f | GATTACCTGAAGGATTTAAAGAATGGAAGAGAGC | (SEQ ID NO: 590) |
| | K9_58G_051611f | GATTACCTGAAGGATTTAAAGGTTGGAAGAGAGC | (SEQ ID NO: 591) |

TABLE 29 forward mutational primers.

| Targeted position(s) of K9-KARI | Primers | | |
|---|---|---|---|
| 56 | K9_56F_071211r | GCTCTCTTCCATGGTTTGAATCCTTC | (SEQ ID NO: 592) |
| | K9_56L_071211r | GCTCTCTTCCATGGTTTCAATCCTTC | (SEQ ID NO: 593) |
| | K9_56Y_071211r | GCTCTCTTCCATGGTTTATATCCTTC | (SEQ ID NO: 594) |
| | K9_56C_071211r | GCTCTCTTCCATGGTTTACATCCTTC | (SEQ ID NO: 595) |
| | K9_56W_071211r | GCTCTCTTCCATGGTTTCCATCCTTC | (SEQ ID NO: 596) |
| | K9_56P_071211r | GCTCTCTTCCATGGTTTTGGTCCTTC | (SEQ ID NO: 597) |
| | K9_56H_071211r | GCTCTCTTCCATGGTTTATGTCCTTC | (SEQ ID NO: 598) |
| | K9_56Q_071211r | GCTCTCTTCCATGGTTTTTGTCCTTC | (SEQ ID NO: 599) |
| | K9_56i_071211r | GCTCTCTTCCATGGTTTCATTCCTTC | (SEQ ID NO: 600) |
| | K9_56M_071211r | GCTCTCTTCCATGGTTTCATTCCTTC | (SEQ ID NO: 601) |
| | K9_56N_071211r | GCTCTCTTCCATGGTTTATTTCCTTC | (SEQ ID NO: 602) |
| | K9_56V_071211r | GCTCTCTTCCATGGTTTAACTCCTTC | (SEQ ID NO: 603) |
| | K9_56A_071211r | GCTCTCTTCCATGGTTTAGCTCCTTC | (SEQ ID NO: 604) |
| | K9_56D_071211r | GCTCTCTTCCATGGTTTATCTCCTTC | (SEQ ID NO: 605) |
| | K9_56E_071211r | GCTCTCTTCCATGGTTTTTCTCCTTC | (SEQ ID NO: 606) |
| | K9_56G_071211r | GCTCTCTTCCATGGTTTACCTCCTTC | (SEQ ID NO: 607) |
| 58 | K9_58F_071211r | GTTCTTCTGCTCTCTTCCAGAATTT | (SEQ ID NO: 608) |
| | K9_58L_071211r | GTTCTTCTGCTCTCTTCGACAATTT | (SEQ ID NO: 609) |
| | K9_58Y_071211r | GTTCTTCTGCTCTCTTCCAATATTT | (SEQ ID NO: 610) |
| | K9_58C_071211r | GTTCTTCTGCTCTCTTCCAACATTT | (SEQ ID NO: 611) |
| | K9_58W_071211r | GTTCTTCTGCTCTCTTCCACCATTT | (SEQ ID NO: 612) |

TABLE 29-continued forward mutational primers.

| Targeted position(s) of K9-KARI | Primers | | |
|---|---|---|---|
| | K9_58P_071211r | GTTCTTCTGCTCTCTTCCATGGTTT | (SEQ ID NO: 613) |
| | K9_58H_071211r | GTTCTTCTGCTCTCTTCCAATGTTT | (SEQ ID NO: 614) |
| | K9_58Q_071211r | GTTCTTCTGCTCTCTTCCATTGTTT | (SEQ ID NO: 615) |
| | K9_58I_071211r | GTTCTTCTGCTCTCTTCCAAATTTT | (SEQ ID NO: 616) |
| | K9_58M_071211r | GTTCTTCTGCTCTCTTCCACATTTT | (SEQ ID NO: 617) |
| | K9_58N_071211r | GTTCTTCTGCTCTCTTCCAATTTTT | (SEQ ID NO: 618) |
| | K9_58V_071211r | GTTCTTCTGCTCTCTTCGAAACTTT | (SEQ ID NO: 619) |
| | K9_58A_071211r | GTTCTTCTGCTCTCTTCCAAGCTTT | (SEQ ID NO: 620) |
| | K9_58D_071211r | GTTCTTCTGCTCTCTTCCAATCTTT | (SEQ ID NO: 621) |
| | K9_58E_071211r | GTTCTTCTGCTCTCTTCCATTCTTT | (SEQ ID NO: 622) |
| | K9_58G_071211r | GTTCTTCTGCTCTCTTCCAACCTTT | (SEQ ID NO: 623) |

TABLE 30

List of some mutants with their measured $K_M$ values

| Mutant | SEQ ID NO: (nucleic acid, amino acid) | Mutations | $K_M$ (μM) (NADH) | $K_M$ (μM) (NADPH) |
|---|---|---|---|---|
| K9 Wt | 26, 27 | — | 326 | 0.2 |
| BI7D12 | 625, 624 | Y53Q, S56V, S58D, I86V, N87P, T131M, T191G | 39 | 196 |
| BI10F1 | 627, 626 | Y53E, S56V, S58D, I86V, N87P, T131M, T191G | 74 | 573 |
| BJ6G6 | 629, 628 | Y53P, S56D, S58Q, I86V, N87P, T131M, T191G | 298 | 672 |
| BJ7D6 | 631, 630 | Y53P, S56V, S58E, I86V, N87P, T131M, T191G | 37 | 236 |
| BJ7F7 | 633, 632 | Y53A, S56D, S58Q, I86V, N87P, T131M, T191G | 269 | 762 |

Example 24

Construction of an ald6Δ Strain and Isobutanol-Producing Derivatives

A 5.3 kb (BglII/EcoRV) DNA fragment from pRS426::GPD-xpk1+ADH-eutD (SEQ ID NO:383) containing expression cassettes for xpk1 and eutD genes from *Lactobacillus plantarum* was added between the ALD6 flanking sequences, at the SnaBI site of the pUC19::ald6D::loxP-URA3-loxP vector described in Example 9, above. The ligation reaction was transformed into *E. coli* Stbl3 cells, which were incubated on LB Amp plates to select for transformants. Insertion of the xpk1-eutD cassette was confirmed by PCR (primers). A positive done (pUC19::Δald6::URA3::xpkS) was obtained.

The vector described above was linearized with AhdI and transformed into PNY1507 (described herein) cells prepared with the Zymo Research Frozen-EZ Yeast Transformation Kit (Cal. No. T2001) with a modification to manufacturer's protocol that included an additional outgrowth incubation of 2.5 hrs. in 2.0 mL YPE (yeast extract, peptone with 1% ethanol) medium. Transformants were obtained by plating on synthetic complete medium minus uracil that provided 1% ethanol as the carbon source. Patched transformants were screened by PCR to confirm the deletion/integration, using primers N1090 and N1213 (SEQ ID NOs: 779 and 242). A plasmid carrying Cre recombinase (pRS423::GAL1p-Cre; SEQ ID No. 271) was transformed into the strain using histidine marker selection. Transformants were passaged on YPE supplemented with 0.5% galactose. Colonies were screened for resistance to 5-FOA (loss of URA3 marker) and for histidine auxotrophy (loss of the Cre plasmid). Proper removal of the URA3 gene via the flanking loxP sites was confirmed by PCR with primers N1212 and N1214 (SEQ ID NOs: 241 and 281). Finally, the alsS integration plasmid (SEQ ID NO:780) was transformed into this strain using the included geneticin selection marker. Integrants were confirmed using primers N160SeqF5 and oBP512 (SEQ ID NO: 388 and 337).

Plasmids pYZ090ΔalsS and pBP915 (SEQ ID NOs: 371 and 182) were transformed into the strain by lithium acetate transformation (Protocol #2 in "Methods in Yeast Genetics" 2005. Amberg, Burke and Strathern). Transformants were selected by plating on synthetic complete minus histidine and uracil with ethanol as the carbon source. Transformants were patched and then repatched onto synthetic complete minus histidine and uracil with 2% glucose and 0.05% ethanol. Six clones were evaluated for growth and isobutanol production. One of these has been designated PNY2216.

Example 25

YMR226c Deletion from *S. Cerevisiae* Strain PNY2211 (Construction of PNY2248)

The gene YMR226c was deleted from *S. cerevisiae* strain PNY2211 (described in Example 9) by homologous recombination using a PCR amplified linear KanMX4-based deletion cassette available in *S. cerevisiae* strain BY4743 ymr226cΔ::KanMX4 (ATCC 4020812). Forward and reverse PCR primers N1237 (SEQ ID NO:784) and N1238 (SEQ ID NO:785), amplified a 2,051 bp ymr226cΔ::KanMX4 deletion cassette from chromosome XIII. The PCR product contained upstream and downstream sequences of 253 and 217 bp, respectively, flanking the ymr226cΔ::KanMX4 deletion cassette, that are 100% homologous to the sequences flanking the native YMR226c locus in strain PNY2211. Recombination and genetic exchange occur at the flanking homologous sequences effectively deleting the YMR226c gene and integrating the ymr226cΔ::KanMX4 deletion cassette.

Approximately 2.0 µg of the PCR amplified product was transformed into strain PNY2211 made competent using the lithium-acetate method previously described in *Methods in Yeast Genetics* (Cold Spring Harbor Laboratory Press, Cold Spring Harbor, N.Y., pp. 201-202 (2005)), and the transformation mix was plated on YPE plus geneticin (50 µg/mL) and incubated at 30° C. for selection of cells with an integrated ymr226cΔ::KanMX4 cassette. Transformants were screened for ymr226cΔ::KanMX4 by PCR, with a 5' outward facing KanMX4 deletion cassette-specific internal primer N1240 (SEQ ID NO:786) paired with a flanking inward facing chromosome-specific primer N1239 (SEQ ID NO:243) and a 3' outward-facing KanMX4 deletion cassette-specific primer N1241 (SEQ ID NO:787) paired with a flanking inward-facing chromosome-specific primer N1242 (SEQ ID NO:244). Positive PNY2211 ymr226cΔ::KanMX4 clones were obtained, one of which was designated PNY2248.

Example 26

Production of Isobutanol with Decreased DHMB Yield in YMR226c Knock-Out

PNY2211 ymr226cΔ::KanMX4 transformants and a non-deletion control (PNY2211 with native YMR226c) were tested for butanol production in glucose medium by first introducing the isobutanol pathway-containing plasmids pYZ090ΔalsS (SEQ ID NO:371) and pBP915 (SEQ ID NO:182) simultaneously by the Quick and Dirty lithium acetate transformation method described in *Methods in Yeast Genetics* (Cold Spring Harbor Laboratory Press, Cold Spring Harbor, N.Y. (2005)). Plasmid selection was based on histidine and uracil auxotrophy on selection plates containing ethanol (synthetic complete medium with 1.0% ethanol-his-ura). After three to five days, several transformants showing the most robust growth were adapted to glucose medium by patching onto SD 2.0% glucose 4-0.05% ethanol-his-ura and incubated 48 to 72 hours at 300° C. Three streaks showing the most robust growth were used to inoculate a 10 mL seed culture in SD 0.2% glucose+0.2% ethanol-his-ura in 125 mL vented flasks and grown at 30° C., 250 rpm for approximately 24 hours. Cells were then subcultured into synthetic complete medium with 2% glucose+0.05% ethanol-his-ura in 125 ml tightly-capped flasks and incubated 48 hours at 30° C. Culture supernatants collected after inoculation and after 48 hours incubation were analyzed by HPLC to determine production of isobutanol and by LC/MS to quantify DHMB. Controls strains were observed to produce DHMB at a molar yield of 0.03 to 0.07 mole per mole glucose. A peak corresponding to DHMB was not observed in culture supernatants of the ymr226cΔ strains, one of which was designated PNY2249.

Example 27

Identification of Genes that Encode Acetolactate Reductase (ALR) Activity Enzymes Using Yeast Knockout Library From a knockout ("KO") collection of >6000 yeast strains derived from the strain BY4743, available from Open Biosystems® (a division of Thermo Fisher Scientific, Waltham, Mass.), 95 candidate dehydrogenase gene knockout strains were chosen. Starter cultures of knockout strains were grown in 96-well deepwell plates (Costar 3960, Corning Inc., Corning N.Y., or similar) on rich medium YPD, and subcultured at a starting OD 600 nm of ~0.3 in medium containing 0.67% Yeast Nitrogen Base, 0.1% casamino acids, 2% glucose, and 0.1 M $K^+$-MES, pH 5.5. Samples were taken over a 5-day period for DHMB and DHIV measurements. DHIV and the two isomers of DHMB were separated and quantified by liquid chromatography-mass spectrometry ("LC/MS") on a Waters (Milford, Mass.) AcquityTQD system, using an Atlantis 13 (part #186003539) column. The column was maintained at 30° C., and the flow rare was 0.5 ml/min. The A mobile phase was 0.1% formic acid in water, and the B mobile phase was 0.1% formic acid in acetonitrile. Each run consisted of 1 min at 99% A, a linear gradient over 1 min to 25% B, followed by 1 min at 99% A. The column effluent was monitored for peaks at m/z=133 (negative ESI), with cone voltage 32.5V, by Waters ACQ_TQD (s/n QBA688) mass spec detector. The so-called "fast DHMB" typically emerged at 1.10 min, followed by DHIV at 1.2 min, and "slow" DHMB emerged at 1.75 min. Baseline separation was obtained and peak areas for DHIV were converted to µM DHIV concentrations by reference to analyses of standards solutions made from a 1M aqueous stock. These measurements showed that most of the changes in DHMB levels occurred in the first 48-60 hours, so a single sample was collected at about that time in subsequent experiments. In this experiment, fast DHMB was found at much higher levels than slow DHMB, which was not always detectable. The ratio of DHIV to fast DHMB in most cultures was ~3, but a strain lacking the YMR226C gene consistently showed very low levels of fast DHMB, and normal DHIV, so that the DHIV/fast DHMB ratio was about 100. This suggested that YMR226Cp is the major ALR in this background.

To confirm that YMR226Cp is the major ALR in this background, the in vitro levels of ALR and KARI were tested in the ymr226c deletion strain (American Type Culture Collection (ATCC), Manassas Va., ATCC #4020812) and its parent, BY4743 (ATCC #201390; American Type Culture Collection, Manassas Va.). Fifty ml tubes containing 6 ml YPD were inoculated from YPD agar plates and allowed to grow overnight (30° C., 250 rpm). The cells were pelleted, washed once in water, and resuspended in 1 ml yeast cytoplasm buffer (Van Eunen et al. *FEBS Journal* 277: 749-760 (2010)) containing a yeast protease inhibitor cocktail (Roche, Basel, Switzerland, Cat #11836170001, used as directed by the vendor, 1 tablet per 10 mls of buffer). Toluene (0.02 ml, Fisher Scientific, Fair Lawn N.J.) was added, and the tubes were shaken at top speed for 10 min on a Vortex Genie 2 shaker (Scientific Industries, Bohemia N.Y., Model G-560) for permeabilization. The tubes were placed in a water bath at 30° C., and substrates were added to the following final concentrations: (S)-acetolactate (made enzymatically as described below in Example 29) to 9.4 mM, NADPH (Sigma-Aldrich, St. Louis Mo.) 0.2 mM plus a NAD(P)H-regeneration system consisting of ~10 mM glucose-6-phosphate and 2.5 U/ml *Leuconostoc mesenteroides* glucose-6-phosphate dehydrogenase (Sigma, St. Louis, Mo., Cat #G8404). At timed intervals, aliquots (0.15 ml) were added to 0.15 ml aliquots of 2% formic acid to stop the reaction. The samples were then analyzed for DHIV and both isomers of DHMB by LC/MS as described above; only fast DHMB and DHIV were observed. The specific activities of the two enzymes in the two strains are shown in Table 31.

TABLE 31

KARI and ALR Enzyme Activities

| Strain | KARI | ALR |
|---|---|---|
| BY4743 | 1.7 mU/mg protein | 20 mU/mg |
| YMR226C deletion strain | 2.2 mU/mg protein | 0.1 mU/mg |

The data suggests that the YMR226C gene product accounted for >99% of the ALR activity.

Example 28

Identification of Genes that Encode Acetolactase Reductase (ALR) Activity Enzymes Using Yeast Overexpression Library From a "Yeast ORF" collection of >5000 transformants of Y258 each with a plasmid carrying a known yeast gene plus a C-terminal tag, under the control of an inducible promoter (Open Biosystems®, a division of Thermo Fisher Scientific, Waltham, Mass.), ninety-six strains with plasmids containing genes associated with dehydrogenase activity were grown in 96-well format by adaptation of the growth and induction protocol recommended by the vendor (Open Biosystems®). The cells were pelleted and permeabilized with toluene as described above, and a concentrated substrate mix was added to give final concentrations as in Example 27. Timed samples were taken and analyzed for DHIV and both isomers of DHMB. The ratios of the ALR/KARI were calculated and compared. Strains with elevated ratios were candidates for overproduction of ALR activities. When the data for relative rates of fast DHMB and DHIV formation were displayed in a Minitab® (Microsoft Inc., Redmond, Wash.) boxplot, half the ratios fell between ~9-13, and most of the rest fell within 3 and 19. The exceptions identified as outliers included YER081W, YIL074C, YMR226C, YBR006W, and YOR375C, for which ratios of ALR/KARI fell between 22 and 40. In a similar analysis of relative rates of slow DHMB and DHIV formation, half the ratios fell between 9 and 11, but YMR226C, YPL275W, YER081W, AND YOL059W appeared as outliers, with ratios between 13 and 25. Thus, overexpression of YMR226C and YER081W, increased synthesis of both DHMBs. In addition, YIL074C, YBR006W, and YOR375C increased fast DHMB synthesis, and YPL275W and YOL059W increased slow DHMB synthesis. The genomic DNA sequences (which may include introns) and ORF translation sequences of genes identified in overexpression are provided in Table 6.

Example 29

Inhibition of KARI by DHMB

Enzymatic Production of (S)-Acetolactate (S)-acetolactate was used as a starting material for DHMB synthesis. (S)-acetolactate was made enzymatically, as follows. An $E.$ $coli$ TOP10 strain (Invitrogen, Carlsbad, Calif.) modified to express $Klebsiella$ BudB (previously described in U.S. Pat. No. 7,851,188, which is herein incorporated by reference in its entirety; see Example 9 of that patent) under IPTG control was used as a source of enzyme. It was grown in 200-1000 ml culture volumes. For example, 200 ml was grown in Luria Broth (Mediatech, Manassas, Va.) containing 0.1 mg/ml Ampicillin (Sigma, St. Louis, Mo.) in a 0.5 L conical flask, which was shaken at 250 rpm at 37° C. At OD 600 ~0.4, isopropylthiogalactoside (Sigma, St. Louis, Mo.) was added to 0.4 mM, and growth was continued for 2 hours before the cells were collected by centrifugation, yielding ~1 g wet weight cells. Likewise, partial purifications were conducted at scales from ~0.5 to 5 g wet cells. For example, ~0.5 g cells were suspended in 2.5 ml buffer containing 25 mM Na-MES pH 6, broken by sonication at 0° C., and clarified by centrifugation. Crude extract was supplemented with 0.1 mM thiamin pyrophosphate, 10 mM $MgCl_2$, and 1 mM EDTA (all from Sigma, St. Louis, Mo.). Next, 0.07 ml of 10% w/v aqueous streptomycin sulfate (Sigma, St. Louis, Mo.) was added and the sample was heated in a 56° C. water bath for 20 min. It was clarified by centrifugation, and ammonium sulfate was added to 50% of saturation. The mixture was centrifuged, and the pellet was brought up in 0.5 ml 25 mM Na-MES, pH 6.2, and used without further characterization. Acetolactate syntheses were also conducted at various scales. A large preparation was conducted as follows: 5.5 g sodium pyruvate was dissolved in 25 mM Na-MES, pH 6.2, to ~45 ml and supplemented with 10 mM MgCl2, 1 mM thiamin pyrophosphate, 1 mM EDTA (all from (Sigma, St. Louis, Mo.), 25 mM sodium acetate (Fisher Scientific, Fair Lawn N.J.), and 0.25 ml of a BudB preparation. The mixture was stirred under a pH meter at room temperature. As the reaction proceeded, $CO_2$ was evolved, and the pH rose, Pyruvic acid (Alfa, Ward Hill, Mass.) was added slowly via peristaltic pump to keep the pH between 6 and 7. As the pH rises, the enzyme reaction slows, but if it is allowed to fall below 6, decarboxylation of acetolactic acid becomes a problem. When the reaction was complete, the mixture was stored at −80° C.

Synthesis of DHMB

DHMB was synthesized chemically from (S)-acetolactate. Three ml of a crude acetolactate preparation at ~0.8 M at pH ~8 was treated with 1.2 equiv $NaBH_4$ (Aldrich Chemical Co, Milwaukee, Wis.). The reaction was allowed to sit at room temperature overnight before being divided in two and desalted in two portions on a 60 cm×1 cm diameter column of Biogel P-2 (Bio-Rad, Hercules, Calif.) using water as the mobile phase. The fractions containing mixed DHMBs were concentrated by rotary evaporation and adjusted to pH 2.2 with sulfuric acid.

The diastereomers of DHMB were separated using an HPLC system (consisting of an LKB 2249 pump and gradient controller (LKB, now a division of General Electric, Chalfont St Giles, UK) and a Hewlett-Packard (now Agilent, Santa Clara, Calif.) 1040A UV/vis detector) with a Waters Atlantis T3 (5 um, 4.6×150 mm) run at room temperature in 0.2% aqueous formic acid, pH 2.5, at a flow rate of 0.3 mL/min, with UV detection at 215 nm. "Fast" DHMB was eluted at 8.1 min and "slow" DHMB was eluted at 13.7 min, DHIV was not present. The pooled fractions were taken nearly to dryness, and coevaporated with toluene to remove residual formic acid. The residue was then dissolved in water and made basic with triethylamine (Fisher, Fair Lawn, N.J.).

Concentration Determination and Absolute Structure of DHMB

The concentration of purified DHMB solutions was determined as follows. The concentration was estimated based on the mmol acetolactate used in the $NaBH_4$ reduction. To portions of the DHMBs, a known quantity of sodium benzoate (made by dissolving solid benzoic acid (ACS grade, Fisher Scientific, Fair Lawn, N.J.) in aqueous NaOH)) was added to give two-component mixtures in (approximately) equimolar amounts. A similar sample of DHIV was also prepared from the solid sodium salt obtained via custom synthesis (Albany Molecular Research, Albany N.Y.). The samples were coevaporated several Limes with $D_2O$ (Aldrich, Milwaukee, Wis.) and redissolved in $D_2O$. Integrated proton NMR spectra were obtained and used to determine the mole ratio of DHIV or DHMB to benzoate. Comparison of the NMR spectra of the DHMBs with the literature spectra for the free acids in $CDCl_3$ (Kaneko et al., *Phytochemistry* 39: 115-120 (1995)) showed that fast DHMB was the erythro isomer. Since enzymatically synthesized acetolactate has the (5) configuration at C-2, the fast DHMB has the 2S, 3S configuration. Slow DHMB has the threo 2S, 3R configuration.

Dilutions of the NMR samples were also analyzed by LC/MS using separately prepared benzoic acid solutions as standards. Benzoic acid, DHIV, and the two isomers of DHMB were separated and quantified by LC/MS on a Waters (Milford, Mass.) AcquityTQD system, using an Atlantis T3 (part #186003539) column, as described above. Benzoic acid was detected at m/z=121 (negative ESI), and emerged at 2.05 min. The concentration of benzoate in the mixtures was within experimental uncertainty of the expected value. The experiment also showed that either isomer of DHMB had ~80% of the sensitivity of DHIV in LC/MS (i.e., MS peak area observed/nmol injected) throughout the response range of the instrument. Thus, if a DHIV standard is used to quantify DHMB found in cell extracts or in enzymatic reactions, the apparent DHMB concentrations need to be multiplied by 1.25.

Measuring Inhibition of KARI by DHMB

Purified KARI encoded by genes either from *Lactococcus lactis* (SEQ ID NO: 864), a derivative of *Pseudomonas fluorescens* KARI known as JEA1 (SEQ ID NO: 799; U.S. Appl. Pub No. 2010/0197519, which is herein incorporated by reference in its entirety), or a variant of *Anaerostipes caccae* KARI known as K9D3 (SEQ ID NO:788), were tested for their sensitivity to DHMB inhibition in spectrophotometric assays in a Shimadzu (Kyoto, Japan) UV160U instrument with a TCC240A temperature control unit, set at 30° C. The buffer was 0.1 M K+ Hepes, pH 6.8, containing 10 mM $MgCl_2$ and 1 mM EDTA. NADPH was present at 0.2 mM, and racemic acetolactate was present at either 3 mM or 0.725 mM (S) isomer. The rate of NADPH oxidation in the presence and absence of either fast or slow DHMB was measured. $V_{max}$ for each sample was calculated from the observed rate and the known acetolactate $K_M$ using the Michaelis-Menten equation. A volumetric K was estimated for each measurement in the presence of DHMB using the Michaelis-Menten equation as modified for competitive inhibition vs. acetolactate (the $K_M$ term in the Michaelis-Menten equation is multiplied by $(1+[I]/K_i)$, and the equation is solved for $K_i$. The results were converted to mM upon completion of the NMR experiment and are shown in Table 32.

TABLE 32

$K_I$ Values for KARI Inhibition by DHMB Isomers

| Strain | Fast DHMB | Slow DHMB |
|---|---|---|
| JEA1 | 0.23 mM | 0.23 mM |
| K9D3 | 0.3 mM | 0.2 mM |
| *L. lactis* | 2.8 mM | 2.3 mM |

Example 30

Inhibition of DHAD by DHMB

Purified dihydroxyacid dehydratase (DHAD) from *Staphylococcus mutans* was tested for inhibition of conversion of dihydroxyisovalerate (DHIV) to 2-ketoisovalerate (2-KIV) by DHMB by using a modification of a colorimetric assay as described by Szamosi et al., *Plant Phys.* 101: 999W-1004 (1993). The assay took place in a 2 mL Eppendorf tube placed in a heating block maintained at 30° C. The assay mixture had a final volume of 0.8 mL containing 100 mM Hepes-KOH buffer, pH 6.8, 10 mM $MgCl_2$, 0.5-10 mM DHIV, 0-40 mM DHMB, and 18 μg DHAD. The assay was initiated by adding a 10× concentrated stock of substrate. Samples were removed (0.35 mL) at times 0.1 and 30 minutes, and the reaction was stopped by mixing into 0.35 mL 0.1 NHC with 0.05% 2,4-dinitrophenylhydrazine (Aldrich) in a second Eppendorf tube. After incubating 30 minutes at room temperature, 0.35 mL of 4N NaOH was added to the mixture, mixed, and centrifuged at 15,000×G for 2 minutes in a centrifuge (Beckman-Coulter Microfuge 18). The absorbance of the solution at 540 nm was then measured in a 1 cm pathlength cuvette using a Cary 300 Bio UV-Vis spectrophotometer (Varian). Based on a standard curve using authentic 2-KIV (Fluka), 1 OD absorbance at 540 nm is produced by 0.28 mM 2-KIV. The rate of 2-KIV formation was measured in the presence and absence of either fast or slow DHMB. Both forms of DHMB behaved liked competitive inhibitors of DHIV. Their inhibition constants (Ki) were calculated from the Michaelis-Menten equation for simple competitive inhibition: $v=S*V_{max}/(S+K_M*(1+I/K_i))$, where v is the measured rate of 2-KIV formation, S is the initial concentration of DHIV, $V_{max}$ is the maximum rate calculated from the observed rate at 10 mM DHIV and no DHMB, $K_M$ is a previously measured constant of 0.5 mM, and I is the concentration of DHMB. The fast and slow isomers of DHMB had calculated inhibition constants of 7 mM and 5 mM, respectively.

Example 31

Identification of YMR226C Homologs

Homologs of the YMR226C gene of *Saccharomyces cerevisiae* were sought by BLAST searches of the GenBank non-redundant nucleotide database (blast.ncbi.nlm.nih.gov/Blast.cgi), the Fungal Genomes BLAST Search Tool at the Saccharomyces Genome Database (www.yeastgenome.org/cgi-bin/blast-fungal.pl), and the BLAST Tool of the Genolevures Project (genolevures.org/blast.html#). Unique sequences from 18 yeast species showing high sequence identity to YMR226C were identified, and the complete ORF for these genes was recovered from the accessioned record in the associated database. The polypeptide sequences encoded by these ORFs were determined by the Translation feature of Vector NTI (Invitrogen, Carlsbad Calif.). The polynucleotide and polypeptide sequences are shown below in Table 33. The yeast species, nucleotide database accession number, and DNA and protein sequences are given in the Table. The *S. kluyveri* sequence is in the Genolevures database under the accession number given; the others are in GenBank. The percent identities between the sequences are shown in Table 34.

The 18 ORFs were aligned using AlignX (Vector NT; the gene encoding a putative NADP+-dependent dehydrogenase from *Neurospora crassa* (XM_957621, identified in the GenBank BLAST search using the YMR226C nucleotide sequence) was used as an outgroup. The resulting phylogenetic tree is shown in FIG. 11, and a sequence alignment is shown in FIGS. 12A-12S.

The sequence identity of these homologs to YMR226C ranges from a minimum of 55% (*Yarrowia lipolytica* and *Schizosaccharomyces pombe*) to a maximum of 90% (*S. paradoxus*). A BLAST search also revealed a cDNA from *S. pastoriarius* (accession number CJ997537) with 92% sequence identity over 484 base pairs, but since this species is a hybrid between *S. bayanus* (whose YMR226C homolog shows 82% identity to the *S. cerevisiae* sequence), and because only a partial ORF sequence was available, this sequence was not included in the comparison. When the YMR226C sequence from the canonical laboratory strain 52880 was compared with the sequences from 12 other strains of *S. cerevisiae*, only 4 single-nucleotide polymorphisms are found (sequence identity 99.5%), indicating that this is a highly-conserved gene in that species.

TABLE 33

YMR226C Yeast Homologs

| Species | Accession # (Date of database accession) | Nucleic acid SEQ ID NO: | Amino acid SEQ ID NO: |
|---|---|---|---|
| Saccharomyces paradoxus | AABY01000127 (Mar. 7, 2011) | 698 | 699 |
| Saccharomyces bayanus | AACA01000631 (Mar. 7, 2011) | 700 | 701 |
| Saccharomyces castellii | AACF01000116 (Mar. 7, 2011) | 702 | 703 |
| Saccharomyces mikatae | AACH01000019 (Mar. 7, 2011) | 704 | 705 |
| Ashbya gossypii | AE016819 (Mar. 7, 2011) | 706 | 707 |
| Candida glabrata | CR380959 (Mar. 7, 2011) | 708 | 709 |
| Debaryomyces hansenii | CR382139 (Mar. 7, 2011) | 710 | 711 |
| Scheffersomyces stipitis (formerly Pichia stipitis | XM_001387479 (Mar. 7, 2011) | 712 | 713 |
| Meyerozyma guilliermondii (formerly Pichia guilliermondii) | XM_001482184 (Mar. 7, 2011) | 714 | 715 |
| Vanderwaltozyma polyspora (formerly Kluyveromyces polysporus) | XM_001645671 (Mar. 4, 2011) | 716 | 717 |
| Candida dubliniensis | XM_002419771 (Mar. 7, 2011) | 718 | 719 |
| Zygosaccharomyces rouxii | XM_002494574 (Mar. 7, 2011) | 720 | 721 |
| Lachancea thermotolerans (formerly Kluyveromyces thermotolerans) | XM_002553230 (Mar. 4, 2011) | 722 | 723 |
| Kluyveromyces lactis | XM_451902 (Mar. 4, 2011) | 724 | 725 |
| Saccharomyces kluyveri | SAKL0H04730 (Mar. 7, 2011) | 726 | 727 |
| Yarrowia lipolytica | XM_501554 (Mar. 8, 2011) | 728 | 729 |
| Schizosaccharomyces pombe | NM_001018495 (Mar. 8, 2011) | 730 | 731 |

TABLE 34

YMR226C Homolog Percent Identity

| Species | Sm | Sb | Sca | Ag | Dh | Ss | Mg | Cd | Cg | Vp | Sk | Kl | Lt | Zr | Sce | Sp | Yl | Nc |
|---|---|---|---|---|---|---|---|---|---|---|---|---|---|---|---|---|---|---|
| Spa | 88 | 82 | 70 | 64 | 62 | 62 | 58 | 57 | 67 | 68 | 68 | 69 | 68 | 68 | 90 | 55 | 55 | 56 |
| Sm | | 82 | 70 | 64 | 60 | 62 | 58 | 56 | 67 | 69 | 68 | 70 | 68 | 69 | 86 | 57 | 56 | 57 |
| Sb | | | 71 | 63 | 59 | 62 | 58 | 53 | 67 | 66 | 68 | 70 | 69 | 67 | 82 | 56 | 56 | 58 |
| Sca | | | | 60 | 62 | 61 | 60 | 59 | 65 | 69 | 69 | 71 | 64 | 70 | 69 | 57 | 53 | 54 |
| Ag | | | | | 56 | 60 | 57 | 54 | 59 | 61 | 62 | 62 | 62 | 62 | 63 | 54 | 55 | 55 |
| Dh | | | | | | 64 | 62 | 61 | 61 | 63 | 62 | 61 | 59 | 63 | 62 | 57 | 57 | 53 |
| Ss | | | | | | | 68 | 64 | 61 | 62 | 62 | 64 | 62 | 63 | 62 | 56 | 58 | 58 |

TABLE 34-continued

YMR226C Homolog Percent Identity

| Species | Sm | Sb | Sca | Ag | Dh | Ss | Mg | Cd | Cg | Vp | Sk | Kl | Lt | Zr | Sce | Sp | Yl | Nc |
|---|---|---|---|---|---|---|---|---|---|---|---|---|---|---|---|---|---|---|
| Mg | | | | | | | | 60 | 57 | 58 | 60 | 60 | 59 | 62 | 59 | 57 | 57 | 56 |
| Cd | | | | | | | | | 57 | 62 | 59 | 60 | 54 | 60 | 58 | 57 | 53 | 49 |
| Cg | | | | | | | | | | 69 | 70 | 68 | 67 | 67 | 66 | 55 | 56 | 55 |
| Vp | | | | | | | | | | | 71 | 72 | 67 | 70 | 71 | 58 | 52 | 51 |
| Sk | | | | | | | | | | | | 77 | 71 | 72 | 69 | 53 | 54 | 54 |
| Kl | | | | | | | | | | | | | 71 | 72 | 71 | 56 | 52 | 54 |
| Lt | | | | | | | | | | | | | | 69 | 69 | 53 | 60 | 58 |
| Zr | | | | | | | | | | | | | | | 69 | 58 | 55 | 55 |
| Sce | | | | | | | | | | | | | | | | 55 | 55 | 56 |
| Spo | | | | | | | | | | | | | | | | | 58 | 60 |
| Yl | | | | | | | | | | | | | | | | | | 61 |
| Nc | | | | | | | | | | | | | | | | | | |

Table 34 Key:
*Saccharomyces paradoxus* ("Spa");
*Saccharomyces mikatae* ("Sm");
*Saccharomyces bayanus* ("Sb");
*Saccharomyces castellii* ("Sca");
*Ashbya gossypii* ("Ag");
*Debaryomyces hansenii* ("Dh");
*Scheffersomyces stipitis* ("Ss");
*Meyerozyma guilliermondii* ("Mg");
*Candida dubliniensis* ("Cd");
*Candida glabrata* ("Cg");
*Vanderwaltozyma polyspora* ("Vp");
*Saccharomyces kluyveri* ("Sk");
*Kluyveromyces lactis* ("Kl");
*Lachancea thermotolerans* ("Lt");
*Zygosaccharomyces rouxii* ("Zr");
*Saccharomyces cerevisiae* ("Sce");
*Schizosaccharomyces pombe* ("Spo");
*Yarrowia lipolytica* ("Yl");
*Neurospora crassa* ("Nc")

Example 32

Prophetic

Screening of Aldehyde Dehydrogenases from *S. Cerevisiae* for Ability to Convert Isobutyraldehyde to Isobutyric Acid Using Enzymatic Assays This example demonstrates a method to determine which endogenous aldehyde dehydrogenases from *S. cerevisiae* can enzymatically convert isobutyraldehyde to isobutyric acid.

*S. cerevisiae* strains containing individual disruptions in the known aldehyde dehydrogenase enzymes are obtained from ATCC: BY4741 Δald2::kanMX4 (ATCC #4000753); BY4741 Δald3::kanMX4 (ATCC #4000752); BY4741 Δald4::kanMX4 (ATCC #4001671); BY4741 Δald5::kanMX4 (ATCC #4000213); and BY4741 Δald6::kanMX4 (ATCC #4002767).

The deletion strains above are first grown overnight in tubes containing 5 ml YPD media at 30° C. The 5 ml overnight cultures are transferred into 100 ml of medium in a 500 ml flask and incubated at 30° C. shaking at 220 rpm. The cultures are harvested when they reach 1 to 2 O.D. at 600 nm. The samples are washed with 10 ml of 20 mill Tris (pH 7.5) and then are resuspended in 1 ml of the same Tris buffer. The samples are transferred into 2.0 ml tubes containing 0.1 mm silica (Lysing Matrix B, MP biomedicals). The cells are then broken in a bead-beater (BIO101). The supernatant is obtained by centrifugation in a microfuge at 13,000 rpm at 4° C. for 30 minutes. Typically, 0.06 to 0.1 mg of crude extract protein is used in a single assay. Protein in the crude extracts was determined by Bradford assay with Coomassie stain.

Aldehyde dehydrogenase activity is measured following a protocol given by Sigma-Aldrich and by Bostian and Betts (Bostian, K. A. and Betts, G. F. (1978) Biochemical Journal 173, 773-786). Crude extracts from the deletion strains above and commercially available aldehyde dehydrogenase are tested using this method.

An alternative assay is to add isobutyraldehyde at concentrations from 1 to 30 mM to approximately 0.1 mg of crude extract protein in a sealed glass GC vials which are incubated at 30° C. for 30 minutes. The extracts are then centrifuged through 0.22 μm spin filters (Corning, Cat #8169) at 3000 rpm for 3 minutes, and the filtrate is transferred to a GC vial for GC-MS analysis. Isobutyraldehyde and isobutyric acid are detected.

The GC method utilizes an Agilent 7890 GC equipped with a 5975 mass spectrometer for detection, and a DB-1701 column (30 m×0.25 mm ID, 0.25 μm film) from Agilent (Santa Clara, Calif.). The carrier gas is helium at a constant flow rate of 1.0 mL/min; injector split is 1:10 at 250° C.; oven temperature is 40° C. for 1 min, 40° C. to 120° C. at 10° O/min, and 120° C. to 240° C. at 30° C./min. MS detection is used in full scan mode for identification and quantitation of isobutyraldehyde and isobutyric acid. Calibrated standard curves are generated for the following compounds: isobutyraldehyde, isobutyric acid, and isobutanol.

Example 33

Construction of Expression Vectors for Isobutanol Pathway Gene Expression in *S. cerevisiae*)

pLH475-JEA1 Construction

The pLH475-JEA1 plasmid (SEQ ID NO: 419) was constructed for expression of ALS and KARI in yeast, pLH475-JEA1 is a pHR81 vector (ATCC #87541) containing the following chimeric genes: 1) the CUP1 promoter (SEQ ID NO:

789), acetolactate synthase coding region from *Bacillus subtilis* (AlsS; SEQ ID NO: 790; protein SEQ ID NO: 791) and CYC1 terminator 2 (SEQ ID NO: 792); 2) an ILV5 promoter (SEQ ID NO: 793), Pf5.IlvC-JEA1 coding region and ILV5 terminator (SEQ ID NO: 794); and 3) the FBA1 promoter (SEQ ID NO: 795), *S. cerevisiae* KARI coding region (ILV5; SEQ ID NO: 796; protein SEQ ID NO: 797) and CYC1 terminator (SEQ ID NO: 798).

The Pf5.IlvC-JEA1 coding region is a sequence encoding KARI derived from *Pseudomonas fluorescens* but containing mutations, that was described in U.S. Patent Application Publication Nos. 2009/0163376 and 2010/0197519, which are herein incorporated by reference in their entireties. The Pf5.IlvC-JEA1 encoded KARI (nucleic acid and amino acid SEQ ID NOs: 799 and 800) has the amino acid changes as compared to the natural *Pseudomonas fluorescens* KARI.

Expression Vector pLH468

The pLH468 plasmid (SEQ ID NO:139) was constructed for expression of DHAD, KivD, and HADH in yeast.

Coding regions for *L. lactis* ketoisovalerate decarboxylase (KivD) and Horse liver alcohol dehydrogenase (HADH) were synthesized by DNA2.0 based on codons that were optimized for expression in *Saccharomyces cerevisiae* (SEQ ID NOs: 801 and 802, respectively) and provided in plasmids pKivDy-DNA2.0 and pHadhy-DNA2.0. The encoded proteins are SEQ ID NOs: 803 and 804, respectively. Individual expression vectors for KivD and HADH were constructed. To assemble pLH467 (pRS426::P$_{TDH3}$-kivDy-TDH3t), vector pNY8; also named pRS426.GPD-ald-GPDt, described in US Patent App. Pub. US2008/0182308, Example 17, which is herein incorporated by reference) was digested with AscI and SfiI enzymes, thus excising the GPD promoter and the ald coding region. A TDH3 promoter fragment (SEQ ID NO: 805) from pNY8 was PCR amplified to add an AscI site at the 5' end, and an SpeI site at the 3' end, using 5' primer OT1068 and 3' primer OT1067 (SEQ ID NOs: 806 and 807). The AscI/SfiI digested pNY8 vector fragment was ligated with the TDH3 promoter PCR product digested with AscI and SpeI, and the SpeI-SfiI fragment containing the codon optimized kivD coding region isolated from the vector pKivD-DNA2.0. The triple ligation generated vector pLH467 (pRS426:: PTDH3-kivDy-TDH3t). pLH467 (SEQ ID NO: 808) was verified by restriction mapping and sequencing. pLH435 (pRS425::PGPM1-Hadhy-ADH1t) was derived from vector pRS425::GPM-sadB (SEQ ID NO: 809) which is described in U.S. Appl. Pub. No, 2009/0305363, Example 3, which is herein incorporated by reference. pRS425::GPM-sadB is the pRS425 vector (ATCC #77106) with a chimeric gene containing the GPM1 promoter (SEQ ID NO: 810), coding region from a butanol dehydrogenase of *Achromobacter xylosoxidans* (sadB; DNA SEQ ID NO: 811; protein SEQ ID NO: 812), and ADH1 terminator (SEQ ID NO: 444). pRS425::GPMp-sadB contains BbvI and PacI sites at the 5' and 3' ends of the sadB coding region, respectively. A NheI site was added at the 5' end of the sadB coding region by site-directed mutagenesis using primers OT1074 and OT1075 (SEQ ID NO: 813 and 814) to generate vector pRS425-GPMp-sadB-NheI, which was verified by sequencing. pRS425::P$_{GPM1}$-sadB-NheI was digested with NheI and PacI to drop out the sadB coding region, and ligated with the NheI-PacI fragment containing the codon optimized HADH coding region from vector pHadhy-DNA2.0 to create pLH435 (SEQ ID NO: 815). To combine KivD and HADH expression cassettes in a single vector, yeast vector pRS411 (ATCC #87474) was digested with SacI and NotI, and ligated with the SacI-SalI fragment from pLH467 that contains the P$_{TDH3}$-kivDy-TDH3t cassette together with the SalI-NotI fragment from pLH435 that contains the P$_{GPM1}$-Hadhy-ADH1t cassette in a triple ligation reaction. This yielded the vector pRS411::P$_{TDH3}$-kivDy-P$_{GPM1}$-Hadhy (pLH441, SEQ ID NO: 816), which was verified by restriction mapping.

In order to generate a co-expression vector for all three genes in the lower isobutanol pathway: ilvD, kivDy and Hadhy, we used pRS423 FBA ilvD(Strep) (SEQ ID NO: 817), as the source of the IlvD gene. This shuttle vector contains an F1 origin of replication (nt 1423 to 1879) for maintenance in *E. coli* and a 2 micron origin (nt 8082 to 9426) for replication in yeast. The vector has an FBA1 promoter (nt 2111 to 3108; SEQ ID NO: 795) and FBA1 terminator (nt 4861 to 5860; SEQ ID NO: 818). In addition, it carries the His marker (nt 504 to 1163) for selection in yeast and ampicillin resistance marker (nt 7092 to 7949) for selection in *E. coli*. The ilvD coding region (nt 3116 to 4828; SEQ ID NO: 819; protein SEQ ID NO: 820) from *Streptococcus mutans* UA159 (ATCC #700610) is between the FBA1 promoter and FBA1 terminator forming a chimeric gene for expression. In addition there is a lumio tag fused to the ilvD coding region (nt 48294849). The first step was to linearize pRS423 FBA ilvD(Strep) (also called pRS423-FBA(SpeI)-IlvD (*Streptococcus mutans*)-Lumio) with SacI and SacII (with SacII site blunt ended using T4 DNA polymerase), to give a vector with total length of 9,482 bp. The second step was to isolate the kivDy-hADHy cassette from pLH441 with SacI and KpnI (with KpnI site blunt ended using T4 DNA polymerase), which gives a 6,063 bp fragment. This fragment was ligated with the 9,482 bp vector fragment from pRS423-FBA(SpeI)-IlvD (*Streptococcus mutans*)-Lumio. This generated vector pLH468 (pRS423::P$_{FBA1}$-ilvD (Strep)Lumio-FBA1t-P$_{TDH3}$-kivDy-TDH3t-P$_{GPM1}$-hadhy-ADH1t), which was confirmed by restriction mapping and sequencing.

Example 34

Construction of *S. Cerevisiae* Host Strain Containing Modifications in Pyruvate Decarboxylase and Hexokinase 2

This example describes insertion-inactivation of endogenous PDC1, PDC5, and PDC6 genes of *S. cerevisiae*. PDC1, PDC5, and PDC6 genes encode the three major isozymes of pyruvate decarboxylase. Hexokinase 2, which is responsible for phosphorylation of glucose and transcriptional repression, is also inactivated. The resulting PDC/HXK2 inactivation strain was used as a host for expression vectors pLH475-JEA1 and pLH468.

Construction of pdc6::P$_{GPM1}$-sadB Integration Cassette and PDC6 Deletion:

A pdc6::P$_{GPM1}$-sadB-ADH1t-URA3r integration cassette was made by joining the GPM-sadB-ADHt segment (SEQ ID NO: 821) from pRS425::GPM-sadB (described in U.S. Patent App. Pub. No. 2009/0305363, incorporated by reference) to the URA3r gene from pUC19-URA3r. pUC19-URA3r (SEQ ID NO: 822) contains the URA3 marker from pRS426 (ATCC #77107) flanked by 75 bp homologous repeat sequences to allow homologous recombination in vivo and removal of the URA3 marker. The two DNA segments were joined by SOE PCR (as described by Horton et al. (1989) *Gene* 77:61-68) using as template pRS425::GPM-sadB and pUC19-URA3r plasmid DNAs, with Phusion DNA polymerase (New England Biolabs Inc., Beverly, Mass.; catalog no. F-540S) and primers 114117-11A through 114117-11D (SEQ ID NOs: 823, 824, 825, 826), and 114117-13A and 114117-13B (SEQ ID NOs: 827 and 828).

The outer primers for the SOE PCR (114117-13A and 114117-13B) contained 5' and 3' ~50 bp regions homologous to regions upstream and downstream of the PDC6 promoter and terminator, respectively. The completed cassette PCR fragment was transformed into BY4700 (ATCC #200866) and transformants were maintained on synthetic complete media lacking uracil and supplemented with 2% glucose at 30° C. using standard genetic techniques (*Methods in Yeast Genetics*, 2005, Cold Spring Harbor Laboratory Press, Cold Spring Harbor, N.Y., pp. 201-202). Transformants were screened by PCR using primers 112590-34G and 112590-34H (SEQ ID NOs: 829 and 830), and 112590-34F and 112590-49E (SEQ ID NOs: 831 and 832) to verify integration at the PDC6 locus with deletion of the PDC6 coding region. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain has the genotype: BY4700 pdc6::$P_{GPM1}$-sadB-ADH1t.

Construction of pdc1::$P_{PDC1}$-ilvD Integration Cassette and PDC1 Deletion:

A pdc1::$P_{PDC1}$-ilvD-FBA1t-URA3r integration cassette (SEQ ID NO: 833) was made by joining the ilvD-FBA1t segment from pLH468 to the URA3r gene from pUC19-URA3r by SOE PCR (as described by Horton of al. (1989) *Gene* 77:61-68) using as template pLH468 and pUC19-URA3r plasmid DNAs, with Phusion DNA polymerase (New England Biolabs Inc., Beverly, Mass.; catalog no. F-540S) and primers 114117-27A through 114117-27D (SEQ ID NOs: 823, 824, 825, 826).

The outer primers for the SOE PCR (114117-27A and 114117-27D) contained 5' and 3' ~50 bp regions homologous to regions downstream of the PDC1 promoter and downstream of the PDC1 coding sequence. The completed cassette PCR fragment was transformed into BY4700 pdc6::$P_{GPM1}$-sadB-ADH1t and transformants were maintained on synthetic complete media lacking uracil and supplemented with 2% glucose at 30° C. using standard genetic techniques (*Methods in Yeast Genetics*, 2005, Cold Spring Harbor Laboratory Press, Cold Spring Harbor, N.Y., pp. 201-202). Transformants were screened by PCR using primers 114117-36D and 135 (SEQ ID NOs 834 and 835), and primers 112590-49E and 112590-30F (SEQ ID NOs 832 and 836) to verify integration at the PDC1 locus with deletion of the PDC1 coding sequence. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain "NYLA67" has the genotype: BY4700 pdc6:: $P_{GPM1}$-sadB-ADH1t pdc1::$P_{PDC1}$-ilvD-FBA1t.

HIS3 Deletion

To delete the endogenous HIS3 coding region, a his3::URA3r2 cassette was PCR-amplified from URA3r2 template DNA (SEQ ID NO: 837). URA3r2 contains the URA3 marker from pRS426 (ATCC #77107) flanked by 500 bp homologous repeat sequences to allow homologous recombination in vivo and removal of the URA3 marker. PCR was done using Phusion DNA polymerase and primers 114117-45A and 114117-453 (SEQ ID NOs: 838 and 839) which generated a ~2.3 kb PCR product. The HIS3 portion of each primer was derived from the 5' region upstream of the HIS3 promoter and 3' region downstream of the coding region such that integration of the URA3r2 marker results in replacement of the HIS3 coding region. The PCR product was transformed into NYLA67 using standard genetic techniques (*Methods in Yeast Genetics*, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened to verify correct integration by replica plating of transformants onto synthetic complete media lacking histidine and supplemented with 2% glucose at 30° C. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain, called NYLA73, has the genotype: BY4700 pdc6:: $P_{GPM1}$-sadB-ADH1t pdc1::$P_{PDC1}$-ilvD-FBA1t Δhis3.

Deletion of HXK2:

A hxk2::URA3r cassette was PCR-amplified from URA3r2 template (described above) using Phusion DNA polymerase and primers 384 and 385 (SEQ ID NOs: 840 and 841) which generated a ~2.3 kb PCR product. The HXK2 portion of each primer was derived from the 5' region upstream of the HXK2 promoter and 3' region downstream of the coding region such that integration of the URA3r2 marker results in replacement of the HXK2 coding region. The PCR product was transformed into NYLA73 using standard genetic techniques (*Methods in Yeast Genetics*, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened by PCR to verify correct integration at the HXK2 locus with replacement of the HXK2 coding region using primers N869 and N871 (SEQ ID NOs: 842 and 843). The URA3r2 marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth, and by PCR to verify correct marker removal using primers N946 and N947 (SEQ ID NOs: 844 and 845). The resulting identified strain named NYLA83 has the genotype: BY4700 pdc6::$P_{GPM1}$-sadB-ADH1t pdc1:: $P_{PDC1}$-ilvD-FBA1t Δhis3 Δhxk2.

Construction of pdc5::kanMX Integration Cassette and PDC5 Deletion

A pdc5::kanMX4 cassette was PCR-amplified from strain YLR134W chromosomal DNA (ATCC No. 4034091) using Phusion DNA polymerase and primers PDC5::KanMXF and PDC5::KanMXR (SEQ ID NOs: 846 and 847) which generated a ~2.2 kb PCR product. The PDC5 portion of each primer was derived from the 5' region upstream of the PDC5 promoter and 3' region downstream of the coding region such that integration of the kanMX4 marker results in replacement of the PDC5 coding region. The PCR product was transformed into NYLA83, and transformants were selected and screened as described above. The identified correct transformants named NYLA84 have the genotype: BY4700 pdc6:: $P_{GPM1}$-sadB-ADH1t pdc1:: $P_{PDC1}$ilvD-FBA1t Δhis3 Δhxk2 pdc5::kanMX4. Plasmid vectors pLH468 and pLH475-JEA1 were simultaneously transformed into strain NYLA84 (BY4700 pdc6::$P_{GPM1}$-sadB-ADH1t pdc1:$P_{PDC1}$-ilvD-FBA1t Δhis3 Δhxk2 pdc5::kanMX4) using standard genetic techniques (*Methods in Yeast Genetics*, 2005, Cold Spring Harbor Laboratory Press, Cold Spring Harbor, N.Y.) and the resulting strain was maintained on synthetic complete media lacking histidine and uracil, and supplemented with 1% ethanol at 30° C.

Example 35

Prophetic

Construction of *S. Cerevisiae* Host Strain Containing Modifications in Pyruvate Decarboxylase Hexokinase 2 and Aldehyde Dehydrogenase This example describes inactivation of one or more aldehyde dehydrogenases that abolish or reduce formation of isobutyric acid. Disruption of ALD2 is used as an example, but the method could be used for disruption of any aldehyde dehydrogenase. The resulting NYLA84-derived strain is used as a host for expression vectors pLH475-JEA1 and pLH468.
Deletion of ALD2:

A ald2::URA3r cassette is PCR-amplified from URA3r2 template (described above) using Phusion DNA polymerase and primers T001 and T002 (SEQ ID NOs: 848 and 849) which generates a ~2.3 kb PCR product. The ALD2 portion of each primer is derived from the 5' sequence and 3' sequence of the ALD2 gene such that integration of the URA3r2 marker results in replacement of the ALD2 coding region. The PCR product is transformed into NYLA84 using standard genetic techniques (*Methods in Yeast Genetics*, 2005, Cold Spring Harbor Laboratory Press, Cold Spring Harbor, N.Y., pp. 201-202) and transformants are selected on synthetic complete media lacking uracil and supplemented with 1% ethanol at 30° C. Transformants are screened by PCR to verify correct integration at the ALD2 locus with replacement of the ALD2 coding region using primers T003 and T004 (SEQ ID NOs: 850 and 851). The URA3r2 marker is recycled by plating on synthetic complete media supplemented with 1% ethanol and 5-FOA at 30° C. following standard protocols. Marker removal is confirmed by patching colonies from the 5-FOA plates onto SE-URA media to verify the absence of growth, and by PCR to verify correct marker removal using primers T004 and T005 (SEQ ID NOs: 851 and 852). The resulting identified strain is named NYLA84 Δald2 and is of the genotype: BY4700 pdc6:: $P_{GPM1}$-sadB-ADH1t pdc1::$P_{PDC1}$-ilvD-FBA1t Δhis3 Δhxk2 Δald2.

Example 36

Production of Isobutanol in Recombinant *S. Cerevisiae* in NYLA84

HPLC Method

Analysis for glucose and fermentation by-product composition is well known to those skilled in the art. For example, one high performance liquid chromatography (HPLC) method utilizes a Shodex SH-1011 column with a Shodex SH-G guard column (both available from Waters Corporation, Milford, Mass.), with refractive index (R1) detection. Chromatographic separation is achieved using 0.01 M $H_2SO_4$ as the mobile phase with a flow rate of 0.5 mL/min and a column temperature of 50° C. Isobutanol retention time is 47.6 minutes.
Production of Isobutanol in Recombinant *S. Cerevisiae* in NYLA84

The purpose of this example is to describe the production of isobutanol in the yeast strain NYLA84. The yeast strain comprises deletions of PDC1, PDC5, and PDC6, genes encoding three isozymes of pyruvate decarboxylase, and deletion of HXK2 encoding hexokinase 2. The strain also contains constructs for heterologous expression of AlsS (acetolactate synthase), KARI (keto acid reductoisomerase), DHAD (dihydroxy acid dehydratase), KivD (ketoisovalerate decarboxylase), SadB (secondary alcohol dehydrogenase), and HADH (horse liver alcohol dehydrogenase).
Strain Construction Plasmids pLH468 and pLH475-JEA1 were introduced into NYLA84, by standard PEG/lithium acetate-mediated transformation methods. Transformants were selected on synthetic complete medium lacking glucose, histidine and uracil. Ethanol (1% v/v) was used as the carbon source. After three days, transformants were patched to synthetic complete medium lacking histidine and uracil supplemented with both 2% glucose and 0.5% ethanol as carbon sources. Freezer vials were made by dilution of log-phase cultures with 45% glycerol to a final glycerol concentration of 15% (w/v).
Production of Isobutanol Freezer vials were used to inoculate 80 ml of synthetic complete medium lacking histidine and uracil supplemented with both 2% glucose and 0.5% ethanol as carbon sources.
Fermentation Conditions:

A 1 liter fermenter was prepared and sterilized with 0.4 L water. After cooling, filter sterilized medium was added to give the following final concentrations in 800 mL post-inoculation:

Medium (Final Concentration):
  6.7 g/L, Yeast Nitrogen Base w/o amino acids (Difco)
  2.8 g/L, Yeast Synthetic Drop-out Medium Supplement Without Histidine, Leucine, Tryptophan and Uracil (Sigma Y2001)
  20 mL/L of 1% (w/v) L-Leucine
  4 mL/L of 1% (w/v) L-Tryptophan
  1 mL/L ergosterol/tween/ethanol solution
  0.2 mL/L Sigma DF204
  10 g/L glucose The fermenter was set to control at pH 5.5 with KOH, 30% dθ, temperature 30° C., and airflow of 0.2 SLPM (or, 0.25 vvm). At inoculation, the airflow was set to 0.01 SLPM initially, then increased to 0.2 SLPM once growth was established. Glucose was maintained at 5-15 g/L throughout by manual addition.

Air was continuously supplied to the fermentor at 0.25 vvm. Continuous aeration led to significant stripping of isobutanol from the aqueous phase of the fermentor. To quantify the loss of isobutanol due to stripping, the off-gas from the fermentor was directly sent to a mass spectrometer (Prima dB mass spectrometer, Thermo Electron Corp., Madison, Wis.) to quantify the amount of isobutanol in the gas stream. The isobutanol peaks at mass to charge ratios of 74 or 42 were monitored continuously to quantify the amount of isobutanol in the gas stream. Glucose and organic acids in the aqueous phase were monitored during the fermentation using HPLC. Glucose was also monitored quickly using a glucose analyzer (YSI, Inc., Yellow Springs, Ohio). Isobutanol in the aqueous phase was quantified by HPLC as described in HPLC Method herein above after the aqueous phase was removed periodically from the fermentor. The effective titer, corrected for the isobutanol lost due to stripping, was 7.5 g/L. The titer of isobutyric acid was 1.28 g/L (FIG. 14).

Example 37

Prophetic

Production of Isobutanol in Recombinant *S. Cerevisiae* in NYLA84 Δald2

The purpose of this example is to describe the production of isobutanol in the yeast strain NYLA84. Disruption of ALD2 is used as an example, but the example could be used for disruption of any aldehyde dehydrogenase. The NYLA84 Δald2 yeast strain comprises deletions of PDC1, PDC5, and PDC6, genes encoding three isozymes of pyruvate decarboxylase, deletion of HXK2 encoding hexokinase 2, and deletion of ALD2 encoding aldehyde dehydrogenase. The strain also contains constructs for heterologous expression of AlsS (acetolactate synthase), KARI (keto acid reductoisomerase), DHAD (dihydroxy acid dehydratase), KivD (ketoisovalerate decarboxylase), and SadB (secondary alcohol dehydrogenase).

Strain Construction

Plasmids pLH468 and pLH475-JEA1 are introduced into NYLA84 Δald2, by standard PEG/lithium acetate-mediated transformation methods. Transformants are selected on synthetic complete medium lacking glucose, histidine and uracil. Ethanol (1% v/v) is used as the carbon source. After three days, transformants are patched to synthetic complete medium lacking histidine and uracil supplemented with both 2% glucose and 0.5% ethanol as carbon sources. Freezer vials are made by dilution of log-phase cultures with 45% glycerol to a final glycerol concentration of 15% (w/v).

Production of Isobutanol

Freezer vials are used to inoculate 80 ml of synthetic complete medium lacking histidine and uracil supplemented with both 0.25% glucose and 0.5% ethanol as carbon sources. A 1 liter fermenter is prepared and sterilized with 0.4 L water. After cooling, filter sterilized medium is added to give the following final concentrations in 800 mL post-inoculation:

Medium (Final Concentration):

6.7 g/L, Yeast Nitrogen Base w/o amino acids (Difco)

2.8 g/L, Yeast Synthetic Drop-out Medium Supplement Without Histidine, Leucine, Tryptophan and Uracil (Sigma Y2001)

20 mL/L of 1% (w/v) L-Leucine 4 mL/L of 1% (w/v) L-Tryptophan 1 mL/L ergosterol/tween/ethanol solution 0.2 mL/L Sigma DF204

10 g/L glucose

The fermenter is set to control at pH 5.5 with KOH, 30% dO, temperature 30° C., and airflow of 0.2 SLPM (or, 0.25 vvm). At inoculation, the airflow is set to 0.01 SLPM initially, then increased to 0.2 SLPM once growth is established. Glucose is maintained at 5-15 g/L throughout by manual addition.

To quantify the loss of isobutanol due to stripping, the off-gas from the fermentor is directly sent to a mass spectrometer (Prima dB mass spectrometer, Thermo Electron Corp., Madison, Wis.) to quantify the amount of isobutanol in the gas stream. The isobutanol peaks at mass to charge ratios of 74 or 42 are monitored continuously to quantify the amount of isobutanol in the gas stream. Glucose and organic acids in the aqueous phase are monitored during the fermentation using HPLC. Glucose is also monitored quickly using a glucose analyzer (YSI, Inc., Yellow Springs, Ohio). Isobutanol and isobutyric acid in the aqueous phase are quantified by HPLC after the aqueous phase was removed periodically from the fermentor.

Example 38

Analysis of Isobutyric Acid Production

Strains were inoculated into synthetic complete medium, minus histidine and uracil, supplemented with 0.05% ethanol. Once cultures had reach stationary phase they were sub-cultured into fresh medium (starting OD=0.2). For PNY2205 (Example 13), medium was supplemented with 0.05% ethanol to satisfy the $C_2$ requirement observed in PDC KO yeast that do not have the phosphoketolase pathway. For PNY2209 (Example 13), cells were subcultured into media with and without ethanol. For the ald6Δ clones (PNY2216 and isogenic clones, Example 24), medium without ethanol was used. Cultures were grown in screw capped shake flasks (20 ml medium in 125 ml flasks). Culture supernatants were collected immediately after inoculation and again after 48 hours. These culture supernatants were analyzed by HPLC (described in US20070092957, incorporated herein by reference) to determine glucose consumption and isobutyric acid concentration.

TABLE 35

Molar yield of isobutyric acid in ald6Δ strains.

| Strain | Isobutyric acid molar yield (mole/mole glucose consumed) |
|---|---|
| PNY2205* | 0.09 |
| PNY2209* | 0.07 |
| PNY2209 | 0.09 |
| PNY2216 and 5 other isogenic clones | 0.03 |

*Indicates culture medium was supplemented with 0.05% ethanol

Example 39

Increased Production of Isobutanol and Decreased by-Product Production in New Strains The purpose of this example is to describe small-scale culturing experiments with the newly constructed strains using plasmid pK9G9.OLE1p.ilvD to supply the remaining isobutanol pathway genes. New host strains PNY1528, PNY2243, PNY2237 and PNY2238 were transformed with plasmid pK9G9.OLE1p.ilvD and tested for isobutanol production. Transformants were obtained by selection on synthetic complete medium minus uracil with 1% ethanol as the carbon source. Transformants were patched on synthetic complete medium minus uracil with 2% glucose and 0.05% ethanol as carbon sources. Patches were used to inoculate liquid medium (synthetic complete minus uracil with 0.3% glucose and 0.3% ethanol as carbon sources). To test isobutanol production, liquid cultures were sub-cultured into synthetic complete medium minus uracil containing 2% glucose and 0.05% ethanol as carbon sources that also contained BME vitamin mix (Sigma Cat. No. B6891). Cultures were incubated in sealed serum vials (10 ml medium in 15 ml vials) at 30° C. with shaking (250 rpm in an Infors Multitron shaker). After 48 hours, culture medium was filtered (Spin-X column) and analyzed by HPLC (as described previously in US App. Pub. No. 20070092957). Molar yield of the pathway by-product isobutyrate was decreased by 50% in strains carrying the ald6Δ. Strains based on PNY2238 were found to have higher glucose consumption and isobutanol titer (done K results shown in the table below).

TABLE 36

Molar Yield of isobutyric acid in the ald6Δ strains

| Strain | Relevant phenotype | Isobutyric acid molar yield (mole/mole glucose consumed) |
|---|---|---|
| PNY2205* | ALD6+, C2-dependent | 0.09 |

TABLE 36-continued

Molar Yield of isobutyric acid in the ald6Δ strains

| Strain | Relevant phenotype | Isobutyric acid molar yield (mole/mole glucose consumed) |
|---|---|---|
| PNY2209* | ALD6+, C2-independent | 0.07 |
| PNY2209 | ALD6+, C2-independent | 0.09 |
| PNY2216 and 5 other isogenic clones | ALD6−, C2-independent | 0.03 |

*indicates the culture medium was supplemented with 0.05% ethanol
All strains contained plasmid pK9G9.OLE1p.ilvD. For PNY2237- and PNY2238-derived strains, the data presented are an average of two biological replicates.

Example 40

Construction of a Site-Saturation Gene Library and Screening the Isobutanol Production of the Resultant Variants in PNY2259

The reverse primer mixture (called K9_309r in this example) containing primers encoding all 20 individual amino acid changes at position 309 (Table 37) and the forward primer K9_131T080211f: GGACTTGATGTCACTAT-GATC (called K9_131Tf in this example) were employed to create a single-site saturation library targeting the position of 309 of K9 KARI. A plasmid containing variant K9SB2 (pHR81-ILV5p.K9SB2.TEF1(M4)p.ilvD (SEQ ID NO: 930, also called "pLH744").

In brief, a megaprimer was prepared through a regular PCR. The megaprimer PCR mixture consisted of 45 µl of SuperMix (Invitrogen, Carlsbad, Calif., #10572063), 2.0 µl K9_131Tf (20 µM), 2.0 µl K9_309r (20 µM) and 1.0 µl template (50 ng/µl). The PCR program for making the megaprimer is: the starting temperature was 95° C. for 1.0 min followed by 35 heating/cooling cycles. Each cycle consisted of 95° C. for 20 sec, 55° C. for 20 sec, and 72° C. for 1.0 min. The megaprimer was then used to introduce mutation into K9SB2 using the same procedure as shown in Example 5. Clones from the single-site saturation library were sequenced.

The resultant unique variants together with pLH744 were analyzed for isobutanol production and by-product formation in yeast (triple for each mutant). Yeast pathway strains were made in PNY2259 (MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t ymr226cΔ ald6Δ::loxP; Example 22) host by transforming the KARI vectors. The transformed cells were plated on synthetic medium without histidine or uracil (1% ethanol as carbon source). Three transformants were transferred to fresh plates of the same media. The transformants were tested for isobutanol production under anaerobic conditions in 48-well plates (Axygen, Union City, Calif. #391-05-061).

Yeast colonies from the transformation on SE-Ura plates appeared after 5-7 days. The three colonies from each variant were patched onto fresh SE-Ura plates, and incubated at 30° C. for 3 days.

Growth Media and Procedure

Two types of media were used during the growth procedure of yeast strains: an aerobic pre-culture media and an anaerobic culture media. AH chemicals were obtained from Sigma unless otherwise noted (St. Louis, Mo.)

Aerobic pre-culture media (SE-Ura): 6.7 g/L yeast nitrogen base without amino acids (Difco, 291940, Sparks, Md.), 1.4 g/L yeast synthetic drop-out medium supplement without histidine, leucine, tryptophan and uracil, 0.2% ethanol, 0.2% glucose, 0.01% w/v leucine, 0.002% w/v histidine, and 0.002% w/v tryptophan.

Anaerobic culture media (SEG-Ura-His): 50 mM MES (pH 5.5, 6.7 g/L yeast nitrogen base without amino acids (Difco, 291940, Sparks, Md.), 1.4 g/L yeast synthetic drop-out medium supplement without histidine, leucine, tryptophan and uracil, 0.1% ethanol, 3% glucose, 0.01% leucine, 0.002% w/v histidine, 0.002% tryptophan, 30 mg/L nicotinic acid, 30 mg/L thiamine and 10 mg/L ergosterol made up in 50150 v/v Tween/ethanol solution.

The patched cells were inoculated into 48-well plates. Each well contains 1.5 ml aerobic media. The plates were covered with permeable foils and grown at 30° C. with shaking overnight. The cell density ($OD_{600}$) was then measured. The amount of cells to make 1.5 ml of cell suspension (in anaerobic media) with the final $OD_{600}$=0.2 for each well were calculated and 1.5 ml cell suspension was prepared with anaerobic media and added into each well. Oxygen in 48-well plates was removed using an anaerobic chamber following the manufacturer's protocol (Coy Laboratory Products Inc. Grass Lake, Mich.). Cells were then grown at 30° C. with shaking for two days. The cell density ($OD_{600}$) was then measured. The best grown mutants underwent the same two-day growth in 48-well plates for isobutanol production measurement. After two days' anaerobic growth, the cell density ($OD_{600}$) was then measured. Cells were centrifuged at 4,000 g for 5 min and the supernatant was collected for the isobutanol measurement using LC/MS.

LC/MS Analysis of Yeast Strains with K9 KARI Mutants

Samples were taken for LCMS analysis at the end of the anaerobic growth period. LCMS analysis was performed using a Waters AcQuity UPLC separations unit and AcQuity TQD triple quad mass spectrometer (Waters, Milford, Mass.) with a Waters AcQuity UPLC HSS T3 separations column (Waters, Milford, Mass.). Compounds were separated using a reverse phase gradient of water (+0.1% formic acid) and acetonitrile (+0.1% formic acid) starting with 99% aqueous and ending with 99% organic, at a flow rate of 0.5 mL/min. Chromatograms were analyzed using Waters Masslynx 4.1 software (Waters, Milford, Mass.). Micro molar yields for isobutanol were calculated using Waters Quanlynx software (Waters, Milford, Mass.) using a calibration curve of triplicate analyses of standards.

TABLE 37

Reverse Primers

| Targeted position(s) of K9-KARI | Primers | |
|---|---|---|
| 309 | K9_309I_111711r: CTTTCTCATAGCCTTAATGTGGAC | (SEQ ID NO: 884) |
| | K9_309L_111711r: CTTTCTCATAGCCTTTAAGTGGAC | (SEQ ID NO: 885) |
| | K9_309Y_111711r: CTTTCTCATAGCCTTATAGTGGAC | (SEQ ID NO: 886) |
| | K9_309C_111711r: CTTTCTCATAGCCTTACAGTGGAC | (SEQ ID NO: 887) |
| | K9_309W_111711r: CTTTCTCATAGCCTTCCAGTGGAC | (SEQ ID NO: 888) |
| | K9_309P_111711r: CTTTCTCATAGCCTTTGGGTGGAC | (SEQ ID NO: 889) |
| | K9_309H_111711r: CTTTCTCATAGCCTTATGGTGGAC | (SEQ ID NO: 890) |
| | K9_309Q_111711r: CTTTCTCATAGCCTTTTGGTGGAC | (SEQ ID NO: 891) |
| | K9_309M_111711r: CTTTCTCATAGCCTTCATGTGGAC | (SEQ ID NO: 892) |
| | K9_309N_111711r: CTTTCTCATAGCCTTATTGTGGAC | (SEQ ID NO: 893) |
| | K9_309V_111711r: CTTTCTCATAGCCTTAACGTGGAC | (SEQ ID NO: 894) |
| | K9_309A_111711r: CTTTCTCATAGCCTTAGCGTGGAC | (SEQ ID NO: 895) |
| | K9_309D_111711r: CTTTCTCATAGCCTTATCGTGGAC | (SEQ ID NO: 896) |
| | K9_309E_111711r: CTTTCTCATAGCCTTTTCGTGGAC | (SEQ ID NO: 897) |
| | K9_309G_111711r: CTTTCTCATAGCCTTACCGTGGAC | (SEQ ID NO: 898) |
| | K9_309S_111711r: CTTTCTCATAGCCTTAGAGTGGAC | (SEQ ID NO: 899) |
| | K9_309T_111711r: CTTTCTCATAGCCTTAGTGTGGAC | (SEQ ID NO: 900) |
| | K9_309R_111711r: CTTTCTCATAGCCTTTCTGTGGAC | (SEQ ID NO: 901) |
| | K9_309K_111711r: CTTTCTCATAGCCTTCTTGTGGAC | (SEQ ID NO: 902) |

TABLE 38

List of some variants with OD$_{600}$ and isobutanol titer (mM) after two days anaerobic growth

| Variant | Amino Acid Seq ID No: | Repeat | OD$_{600}$ | Isobutanol titer (mM) |
|---|---|---|---|---|
| K9C4 | 927 | 1 | 0.5502 | 76.99 |
| | | 2 | 0.6578 | 84.05 |
| | | 3 | 0.7301 | 98.91 |
| K9C8 | 928 | 1 | 0.6887 | 116.57 |
| | | 2 | 0.5309 | 78.77 |
| | | 3 | 0.6859 | 102.49 |
| K9SB2 | 427 | 1 | 0.6314 | 88.39 |
| | | 2 | 0.5977 | 81.18 |
| | | 3 | 0.2325 | 44.60 |

Example 41

Construction of K9SB2 SH (K9SB2 Short), a Truncated Version of K9SB2

A gene encoding a version of K9SB2 lacking the first five N-terminal amino acids (MEECK) was prepared by PCR with the Phusion® High-Fidelity PCR Kit (Catalog #E0553L, New England Biolabs). Primers Kshort1 (AAAC-CGGTTTAAACAGTATGGCTAAGATTTAC-TACCAAGAAGACTG; SEQ ID NO: 903) and YGrev (TTCTGTTTTATCAGACCGCTTC; SEQ ID NO: 904) were synthesized by Integrated DNA Technologies, Inc (Coralville Iowa). Other than the primers, dNTP mix (Cat #18427-013, Invitrogen, Carlsbad, Calif.), template, and ddH$_2$O, reagents used here were supplied with the kit indicated above. The PCR mixture consisted of 1 µl of K9SB2 in a pBAD.KARI plasmid (20 ng/µl; plasmid preparation described in Example 17; SEQ ID NO: 428), 2 µl of each primer (20 µM stocks), 10 µl of 5× Phusion HF Buffer, 2 µl of 5 mM dNTP mix, 0.5 µl polymerase, and 28 µl of ddH$_2$O. The following conditions were used for the PCR reaction: The starting temperature was 98° C. for 2 min followed by 30 heating/cooling cycles. Each cycle consisted of 98° C. for 10 sec, 48° C. for 30 sec, and 72° C. for 1.5 min. At the completion of the temperature cycling, the sample was kept at 72° C. for 10 min more, and then held awaiting sample recovery at 4° C. The reaction product was separated from the template via agarose gel electrophoresis (1% agarose, 1×TBE buffer) and recovered using the Illustra GFX™ PCR DNA and Gel Band Purification Kit (Cat #28-9034-70, GE Healthcare Sciences, Piscataway, N.J.) as recommended by the manufacturer. The purified PCR product was digested with PmeI and SfiI and ligated into the corresponding sites of pBAD-ps-JEA1 (SEQ ID NO: 905) and the sequence of the resultant construct K9SB2_SH in pBAD.KARI (SEQ ID NO: 929) was confirmed.

Example 42

Generation of Yeast Expression Plasmids for Studies of K9SB2 and Other KARI Enzymes Construction of pHR81-ILV5p-K9SB2-TEF(M4)-IlvD (pLH744; SEQ ID NO: 930):

The K9SB2 gene was excised from pHR81-ILV5p-K9SB2 by PmeI and SfiI digestion, and ligated with pHR81-ILV5p-K9D3-TEF(M4)-IlvD (pBP2090) at PmeI and SfiI sites. The ligated vector was named pHR81-ILV5p-K9SB2-TEF(M4)-IlvD (pLH744), and this vector was confirmed by sequencing.

Construction of K9SB2 SH DHAD (SEQ ID NO: 931):

The digested K9SB2_SH PCR product (described in example 41) was ligated into PmeI and SfiI sites of pLH744 and confirmed by sequencing.

Construction of K9SB2_SH_81 (SEQ ID NO: 932)

The digested K9SB2_SH PCR product (described in example 41) was ligated into PmeI and SfiI sites of pHR81-PIlv5-KARI-K9.G9 and confirmed by sequencing.

Construction of Plasmids for Yeast Expression of K9SB2 Derivatives

The yeast expression plasmids for variants listed in Table 39 (described in examples 17 and 21) were generated by subcloning the corresponding KARI genes from pBAD.KARI plasmids into the PmeI and SfiI sites of plasmid pLH744 and plasmid pHR81-PIlv5-KARI-K9.G9. The constructs were confirmed by sequencing.

TABLE 39

K9SB2 derivatives subcloned into yeast expression plasmids

| K9SB2 Derivative | Alternate name | Amino Acid Sequence ID | Nucleic Acid Sequence ID |
|---|---|---|---|
| K9SB2-K90M | K9_David | 431 | 432 |
| K9SB2-G55D | K9_Eliza | 433 | 946 |
| K9SB2-Q91L | K9_Frank | 440 | 947 |
| K9SB2-A303D | K9_Grace | 445 | 948 |
| K9SB2-M94-V307I | K9_Ingrid | 455 | 949 |
| K9SB2-F67I | K9_Jarvis | 437 | 950 |
| K9SB2-A56G-K90N | K9_Kelly | 452 | 951 |
| K9SB2-G55C | K9_Norman | 481 | 952 |
| K9SB2-P135S | K9_Ophelia | 488 | 953 |
| K9SB2-F53L | K9_Pat | 441 | 954 |
| K9SB2-Q94I | K9_Quentin | 495 | 955 |
| K9SB2-F67L | K9_Ralph | 496 | 956 |
| K9SB2-K8N-K90M-T141I | K9_Sophia | 502 | 957 |
| K9SB2-E13V-M94I-T141I | K9_Tiberius | 509 | 958 |
| K9SB2-A56V | K9_Ursala | 511 | 959 |
| K9SB2-I84L | K9_Victor | 514 | 960 |
| K9SB2-W59C | K9_Watson | 520 | 961 |
| K9SB2-T93A | K9_Xavier | 641 | 642 |

Construction of Plasmids for Yeast Expression of Truncated Versions of K9SB2 Derivatives N-terminally truncated versions of K9SB2 derivatives were prepared as described in example 41, with modifications. The primer Kshort1 was replaced with the 5'-phosphorylated primer KPSH1 (AAACAGTATG GCT AAG ATT TAC TAC CAA GAA GAC TG; SEQ ID NO: 906), which was synthesized by Integrated DNA Technologies, Inc (Coralville Iowa). K9SB2 in the PCR was replaced by pooled mixtures of the variants (pBAD.KARI plasmids) listed in Table 39. The purified PCR products were digested with SfiI and ligated Into the PmeI and SfiI sites of pHR81-PIlv5-KARI-K9.G9. DNA sequencing with TempliPhi™ (GE Healthcare) and primers pHR81-F (ACACCCAGTATTTTC-CCTTTCC) and pHR81-Rev (CTA GTG TAC AGA TGT ATG TCG G) (SEQ ID NOs: 924 and 925) was performed to identify each truncated derivative. The identified variants are indicated in Table 40. The coding sequences for the truncated versions were subsequently subcloned into the PmeI and SfiI sites of plasmid pLH744 and confirmed by sequencing.

TABLE 40

Truncated versions of K9SB2 derivatives

| Variant | Amino Acid Sequence ID | Nucleic Acid Sequence ID |
|---|---|---|
| K9_David_SH | 196 | 263 |
| K9_Eliza_SH | 266 | 907 |
| K9_Frank_SH | 267 | 908 |
| K9_Grace_SH | 389 | 909 |
| K9_Ingrid_SH | 405 | 910 |
| K9_Jarvis_SH | 781 | 911 |
| K9_Kelly_SH | 782 | 912 |
| K9_Norman_SH | 783 | 913 |
| K9_Ophelia_SH | 835 | 914 |
| K9_Pat_SH | 853 | 915 |
| K9_Quentin_SH | 854 | 916 |
| K9_Ralph_SH | 855 | 917 |
| K9_Ursala_SH | 856 | 918 |
| K9_Watson_SH | 857 | 858 |
| K9_Xavier_SH | 859 | 919 |

Construction of K9_Zeke_SH (K9SB2-K90M-T93A) and K9_Annabel_SH (K9SB2-K90M-T93I)

K9_Zeke_SH (SEQ ID NO: 860, protein SEQ ID NO: 861) and K9_Annabel_SH (SEQ ID NO: 862, protein SEQ ID NO: 863) were derived from K9_David_SH via site directed mutagenesis employing the employing the QuikChange® Lightning Site-Directed Mutagenesis Kit (Catalog #210518; Agilent Technologies, Stratagene Products Division, La Jolla, Calif.). Except for the primers, templates, and ddH$_2$O, all reagents used here were supplied with the kit indicated above. Primers were synthesized by Integrated DNA Technologies, Inc (Coralville Iowa).

For K9_Zeke_SH, primers employed were oMT93A (GATCCCAGATGAAATGCAGGCTGCCATG-TACAAAAACGACATCG; SEQ ID NO: 920)) and oMT93Arev (CGATGTCGTTTTTGTACATGGCAGCCT-GCATTTCATCTGGGATC; SEQ ID NO: 921). The reaction mixture contained 1 µl K9_David_SH in the pHR81-PIlv5-KARI-K9.G9-derived vector (20 ng/µl), 1 µl of each primer (150 ng/ul), 5 µl of 10× reaction buffer, 1 µl of dNTP mix, 1.5 µl QuikSolution, 1 ul QuikChange Lightning enzyme, and 38.5 µl ddH$_2$O. For K9_Annabel_SH, the primers were replaced with oMT93I (GATCCCAGATGAAATGCAGGC-TATCATGTACAAAAACGACATCG; SEQ ID NO: 922) and oMT93Irev (CGATGTCGTTTTTGTACATGATAGC-CTGCATTTCATCTGGGATC; SEQ ID NO: 923).

The following conditions were used for both reactions: The starting temperature was 95° C. for 2 min followed by 18 heating/cooling cycles. Each cycle consisted of 95° C. for 20 sec, 60° C. for 10 sec, and 68° C. for 6 min. At the completion of the temperature cycling, the samples held awaiting sample recovery at 4° C. 2 µl of the Dpn I was added to each reaction and the mixtures were incubated for 1 hour at 37° C. 2 µl of each mutagenic reaction was transformed into One Shot® StbI3™ Chemically Competent E. coli (Invitrogen, Catalog #C7373-03) according to the manufacturer's instructions. The transformants were spread on agar plates containing the LB medium and 100 µg/ml ampicillin (Cat #L1004, Teknova Inc. Hollister, Calif.) and incubated at 37° C. overnight. Multiple transformants were then selected for TempliPhi™ DNA Sequencing™ (GE Healthcare), which employed primers pHR81-F (ACACCCAGTATTTTCCCTTTCC; SEQ ID NO: 924) and pHR81-Rev (CTA GTG TAC AGA TGT ATG TCG G; SEQ ID NO: 925). Variants with the confirmed sequences (K9_Zeke_SH and K9_Annabel_SH in pHR81-PIlv5-KARI-K9.G9 derived vectors) were subcloned into the PmeI and SfiI sites of pLH744 (SEQ ID NO: 930).

Example 43

Isobutanol Production of K9SB2 and Derivatives Grown Under Anaerobic Conditions in 48-Well Plates The yeast expression plasmids for K9SB2, K9SB2_SH, and K9SB2-T93A, prepared with vector derived from pLH744 as described in Example 42, were employed to evaluate isobutanol production in yeast grown under anaerobic conditions in a 48-well plate. Isobutanol production strains were made in host PNY2259 (MATa ura3Δ::loxP his3Δ pdc6Δ pdc1 Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t ymr226cΔ ald6Δ::loxP) by transforming the plasmids containing the coding sequences for the KARI variants and plating on synthetic medium without uracil (1% ethanol as carbon source). Yeast colonies from the transformation on SE-Ura plates appeared after 3-5 days of incubation at 30° C. At least three colonies from each variant were patched onto fresh SE-Um plates and incubated at 30° C.

Yeast Cultivation Conditions:
Aerobic cultivation medium: SE-Ura medium with 2 g/l ethanol.
Anaerobic cultivation medium: SEG-Ura with 30 g/l glucose and 1 g/l ethanol, supplemented with 10 mg/l ergosterol, 50 mM MES buffer (pH 5.5), 30 mg/l thiamine, and 30 mg/l nicotinic acid.
48-well plates: Axygen catalog #P-5ML-48-C-S, 5 ml/well total volume, culture volume of 1.5 ml/well.

Plates were covered with a permeable adhesive film (VWR; catalog number 60941-086) for aerobic cultivation. Plates were shaken at 225 rpm at 30° C. For anaerobic cultivation, freshly inoculated plates covered with permeable film were purged of oxygen by equilibration in an anaerobic chamber for 2 hours. The plate covers were then exchanged for adhesive aluminum covers (VWR; catalog number 89049-034) and each plate was placed into an airtight plastic box (Mitsubishi Gas Chemical America, Inc; New York, N.Y.; Catalog 50-25) along with a fresh oxygen scavenger pack (Mitsubishi Gas Chemical America, Inc; New York, N.Y.; Catalog 10-01). The entire assembly (plate(s) and oxygen scavenger pack inside a sealed airtight plastic box) was removed from the anaerobic chamber and shaken at 225 rpm at 30° C.

Experimental Protocol
Single yeast colonies on SE-Ura agar plates were streaked onto fresh SE-Ura agar plates and incubated at 30° C. until dense patches of cells had grown. Liquid precultures in 48-well plates were inoculated with loops of these cells for initial aerobic cultivation. After shaking overnight, the $OD_{600}$ of each culture well was measured by transferring 0.15 ml of each well into a flat-bottom 96-well plate and measuring the absorbance of each well at 600 nm with a Molecular Devices (Sunnyvale, Calif.) plate reader. A linear transformation based on an experimentally-determined calibration line was applied to these plate reader-measured optical densities to convert them into comparable absorbance values for a cuvette-based spectrophotometer.

A calculated portion of each aerobic preculture well was inoculated into the corresponding well of a fresh 48-well plate with 1.5 ml of the SEG-Ura medium, to achieve an initial $OD_{600}$ (in cuvette spectrophotometer absorbance units) of 0.2. In the process of inoculating the fresh plate, the aerobic preculture plate was centrifuged, the supernatant was removed from each well, and the cells in each well were resuspended in fresh SEG-Ura medium. This anaerobic cultivation plate was shaken for 3 days. The isobutanol concentration in the culture supernatants was measured by HPLC (Table 41).

TABLE 41

Isobutanol titers reached in the first anaerobic passaging cycle

| Variant | # wells | Mean Isobutanol Titer (mM) | Standard Deviation of Isobutanol Titer (mM) |
| --- | --- | --- | --- |
| K9SB2 | 16 | 35.2 | 11.9 |
| K9SB2_SH | 8 | 67.4 | 12.2 |
| K9SB2-T93A | 8 | 40.8 | 9.1 |

A follow-up anaerobic cultivation was initiated from the first anaerobic cultivation as follows: A calculated portion of each anaerobic culture well was inoculated into the corresponding well of a fresh 48-well plate with 1.5 ml of the SEG-Ura medium, to achieve an initial $OD_{600}$ (in cuvette spectrophotometer units) of 0.2. In the process of inoculating the fresh plate, the growth plate was centrifuged, the supernatant was removed from each well, and the cells in each well were resuspended in fresh SEG-Ura medium, in order to minimize carryover of metabolites from one cultivation to the next. The follow-up (second-cycle) anaerobic cultivation plate was shaken for 2 days. The isobutanol concentration in the culture supernatants was measured by HPLC (Table 42).

TABLE 42

Isobutanol titers reached in the second anaerobic passaging cycle

| Variant | # wells | Mean Isobutanol Titer (mM) | Standard Deviation of Isobutanol Titer (mM) |
| --- | --- | --- | --- |
| K9SB2 | 16 | 67.6 | 10.8 |
| K9SB2_SH | 8 | 85.7 | 9.2 |
| K9SB2-T93A | 8 | 76.3 | 16.8 |

Example 44

Kinetic Characterization of K9G9, K9SB2, and K9SB2 SH

K9G9, K9SB2, K9SB2_SH were overexpressed via pBAD.KARI plasmids in *E. coli* strain Bw25113 (ΔilvC) and purified for detailed measurement of the kinetic parameters.

Expression, purification and cofactor kinetic analyses were performed as described in example 18, with the following modifications. Expression cultures were grown in 20 mL of LB with 100 μg/mL ampicillin and 0.2% (w/v) arabinose in a 125 mL vented cap flask. The expression media was inoculated with 1/10 volume of 8 hour culture. Expression cultures were grown for 18 hours for K9 SB2 and 24 hours for K9SB2_SH.

TABLE 43

Kinetic Parameters Comparing Reactions with NADH and NADPH

| Variant | SEQ ID NO: | $V_{max}$ NADPH, U/mg | $K_m$ NADPH, μM | $V_{max}/K_m$ NADPH, L/min * mg | $V_{max}$ NADH, U/mg | $K_m$ NADH, μM | $V_{max}/K_m$ NADH, L/min * mg |
|---|---|---|---|---|---|---|---|
| K9G9 | 644 | 2.2 | 24.1 | 0.091 | 1.9 | 78.2 | 0.024 |
| K9SB2 | 427 | 1.7 | 44.8 | 0.038 | 1.8 | 11.6 | 0.155 |
| K9SB2_SH | 637 | 1.7 | 109.9 | 0.015 | 1.7 | 13.3 | 0.128 |

Example 45

Isobutanol Production of K9SB2 and Derivatives

Isobutanol production analysis in 48-well plates was performed, as described, in example 42, with the following modifications. Aerobic and anaerobic cultivation media are the same as those described in example 19, but with 0.01% w/v histidine added. $OD_{600}$ values of aerobic precultures were measured using a Cary 300 spectrophotometer (Agent Technology, Wilmington, Del.). A Heraeus Multifug X1R with a M-20 rotor (Thermo Scientific, Waltham, Mass.) was used to pellet the aerobic pre-culture cells and the spent cultivation media was discarded. The plates with cell pellets were transferred into the Coy Anaerobic Bag (Grass Lake, Mich.) and 100 μL of anaerobic cultivation media was added to each pellet. The anaerobic cultivation media was allowed to degas for at least 24 hours prior to the 48-well plate receiving 1.5 mL aliquots; this process was performed inside the anaerobic bag. The anaerobic culture plate was inoculated with the appropriate volume of cell resuspension and covered with an adhesive aluminum foil. Plates were placed into a MCG 2.5 L AnaeroPack system (MCG, Japan). The box was sealed and removed from the anaerobic bag and placed in a 30° C. incubator for 80 hours with shaking at 220 rpm. Three transformants were analyzed per variant, six transformations were analyzed for K9D3 and K92B2 (Table 44).

TABLE 44

Isobutanol Titers

| Variant | SEQ ID NO: | Isobutanol Titer, mM |
|---|---|---|
| K9D3 | 645 | 76.4 ± 9.7 |
| K9SB2 | 427 | 93.8 ± 3.3 |
| K9_Frank | 440 | 27.8 ± 0.5 |
| K9_Grace | 445 | 89.4 ± 15.5 |
| K9_Ingrid | 455 | 88.3 ± 5.4 |
| K9_Jarvis | 437 | 91.8 ± 5.8 |
| K9_Kelly | 452 | 40.9 ± 4.5 |
| K9_Norman | 481 | 66.2 ± 10.6 |
| K9_Ophelia | 488 | 28.3 ± 5.3 |
| K9_Pat | 441 | 77.1 ± 25.6 |
| K9_Quentin | 495 | 80.1 ± 10.8 |
| K9_Ralph | 496 | 82.1 ± 21.3 |
| K9_Sophia | 502 | 25.3 ± 13.4 |
| K9_Tiberius | 509 | 11.4 ± 10.4 |
| K9_Ursala | 511 | 57.3 ± 26.2 |
| K9_Victor | 514 | 93.0 ± 11.4 |

Isobutanol production analysis in serum vials was performed for select variants as described in Example 19, with the following modifications. KARI variants were expressed in yeast from plasmids derived from pLH744, prepared as described in Example 42. Histidine was added to both the aerobic pre-culture and anaerobic growth media to a final concentration of 0.01% w/v. Three or four transformants were analyzed per variant (Table 45, 46, and 47).

TABLE 45

Isobutanol Titers Experiment 1

| Variant | SEQ ID NO: | Passage | Hours | Isobutanol Titer, mM | Isobutanol/ Glycerol |
|---|---|---|---|---|---|
| K9SB2 | 427 | 1 | 75 | 28.2 ± 6.85 | 2.11 ± 0.16 |
| K9SB2_SH | 637 | 1 | 75 | 87.9 ± 1.04 | 2.49 ± 0.04 |
| K9SB2 | 427 | 2 | 48 | 85.0 ± 4.35 | 2.67 ± 0.06 |
| K9SB2_SH | 637 | 2 | 48 | 97.4 ± 4.79 | 2.49 ± 0.07 |

TABLE 46

Isobutanol Titers Experiment 2

| Variant | SEQ ID NO: | Passage | Hours | Isobutanol Titer, mM | Isobutanol/ Glycerol |
|---|---|---|---|---|---|
| K9SB2 | 427 | 1 | 44 | 30.2 ± 4.1 | 2.30 ± 0.15 |
| K9SB2_SH | 637 | 1 | 44 | 40.3 ± 5.6 | 2.41 ± 0.07 |
| K9_David | 431 | 1 | 44 | 36.2 ± 3.5 | 2.40 ± 0.10 |
| K9_David_SH | 196 | 1 | 44 | 41.9 ± 6.4 | 2.37 ± 0.04 |
| K9_Grace | 445 | 1 | 44 | 40.2 ± 5.5 | 2.30 ± 0.05 |
| K9_Pat | 441 | 1 | 44 | 29.0 ± 3.1 | 2.35 ± 0.10 |
| K9SB2 | 427 | 2 | 46 | 59.2 ± 0.6 | 2.61 ± 0.03 |
| K9SB2_SH | 637 | 2 | 46 | 74.8 ± 3.0 | 2.58 ± 0.03 |
| K9_David | 431 | 2 | 46 | 63.8 ± 0.6 | 2.65 ± 0.06 |
| K9_David_SH | 196 | 2 | 46 | 76.7 ± 1.5 | 2.53 ± 0.04 |
| K9_Grace | 445 | 2 | 46 | 62.3 ± 3.1 | 2.52 ± 0.07 |
| K9_Pat | 441 | 2 | 46 | 50.1 ± 2.1 | 2.48 ± 0.07 |

TABLE 47

Isobutanol Titers

| Variant | SEQ ID NO: | Passage | Hours | Isobutanol Titer, mM |
|---|---|---|---|---|
| K9SB2 | 427 | 2 | 50 | 66.2 ± 1.8 |
| Annabel_SH | 862 | 2 | 50 | 74.4 ± 2.4 |
| Zeke_SH | 860 | 2 | 50 | 76.8 ± 8.3 |

TABLE Z

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 1(Q) | -650 | * | -1463 | -44 | -1453 | -1166 | -219 | -1455 | 321 | -1417 | -911 | -227 | -1496 | 3263 | 122 | -643 | -684 | -1239 | -1542 | -1030 | 7100% |
| — | -648 | -1356 | -136 | 43 | -381 | 399 | 106 | -626 | 210 | -466 | -720 | 275 | 394 | 45 | 96 | 359 | 117 | -369 | -294 | -249 | |
| — | -38 | -500 | 233 | -894 | -1115 | -701 | -1378 | -650 | * | | | | | | | | | | | | |
| 2(M) | -4231 | -5840 | -6882 | -5402 | -3438 | -4370 | -4528 | -3232 | -5113 | -2613 | 5320 | -5052 | -4790 | -4977 | -4823 | -4692 | -4459 | -3629 | -4103 | -4017 | 7200% |
| — | -147 | -3929 | -5216 | 42 | -382 | 397 | 104 | -625 | 209 | -467 | -722 | 276 | 396 | 44 | 95 | 361 | 121 | -368 | -296 | -251 | |
| — | -3303 | -501 | 232 | -894 | -136 | -701 | -1378 | * | | | | | | | | | | | | | |
| 3(F) | -1308 | -3318 | -325 | -3473 | 3516 | -2093 | -244 | -196 | -1891 | 64 | 66 | -1626 | -2278 | -1503 | -1798 | -1617 | -1350 | -389 | 305 | 1335 | 8600% |
| — | -149 | -1104 | -2227 | -2120 | -381 | 399 | 106 | -626 | 210 | -466 | -720 | 275 | 394 | 45 | 96 | 359 | 117 | -369 | -294 | -249 | |
| — | -38 | -500 | 233 | -894 | -1115 | -943 | -1060 | * | | | | | | | | | | | | | |
| 4(A) | 1616 | -1744 | 1125 | 33 | -2015 | -1540 | -262 | -1686 | 937 | -1765 | -911 | -252 | -1658 | 154 | -383 | -488 | 640 | -3 | -2038 | -1421 | 8700% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -901 | -5840 | -6882 | -894 | -1115 | -2352 | -314 | * | | | | | | | | | | | | | |
| 5(C) | -346 | 2578 | 1084 | -712 | 2092 | -1540 | -384 | -167 | -624 | -482 | 125 | -731 | -1705 | -451 | -883 | -631 | -338 | -50 | -774 | -133 | 8800% |
| — | -149 | -500 | 235 | 43 | -381 | 398 | 106 | -626 | 210 | -466 | -721 | 275 | 394 | 45 | 96 | 359 | 118 | -369 | -295 | -249 | |
| — | -1009 | -7402 | -1125 | -894 | -1115 | -1916 | -444 | * | | | | | | | | | | | | | |
| 6(S) | 800 | -1006 | -7567 | -131 | -3527 | -1740 | -954 | 1279 | -1204 | -584 | 19 | -1258 | 57 | -1013 | -1358 | 1715 | -476 | 1117 | -1320 | -938 | 9000% |
| — | -149 | -586 | -1937 | -1415 | -821 | 399 | 106 | -626 | 210 | -466 | -720 | 275 | 394 | 45 | 96 | 359 | 117 | -369 | -294 | -249 | |
| — | -17 | -500 | 233 | -894 | -381 | -146 | -3378 | * | | | | | | | | | | | | | |
| 7(K) | -956 | -6953 | -803 | 501 | -2743 | -1919 | -558 | -2483 | 2435 | -2420 | -1502 | 57 | -2010 | 1146 | 458 | 829 | 224 | -2040 | -2577 | -1913 | 9100% |
| — | -149 | -2411 | 233 | 43 | -381 | 399 | 106 | -626 | 210 | -466 | -720 | 275 | 394 | 45 | 96 | 359 | 117 | -369 | -294 | -249 | |
| — | -8 | -500 | -9181 | -894 | -1115 | -701 | -1378 | * | | | | | | | | | | | | | |
| 8(V) | -2472 | -2010 | -5089 | -4702 | -2534 | -4789 | -4391 | 2241 | -4574 | -151 | -1318 | -4442 | -4600 | -4417 | -4628 | -4080 | -82 | 3023 | -3952 | -3510 | 9200% |
| — | -149 | -500 | 233 | 43 | -381 | 399 | 106 | -626 | 210 | -466 | -721 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 9(Y) | -4673 | -3685 | -5210 | -5505 | 2423 | -5069 | -1332 | -3424 | -5065 | -392 | -2838 | -3726 | -4920 | -3835 | -4458 | -4313 | -4533 | -3643 | -581 | 4349 | 9300% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 10(Y) | -2170 | -2625 | -2489 | -2097 | -1555 | -2986 | -1481 | -2628 | 906 | -2674 | -2098 | -2051 | -3206 | -1513 | -1078 | -2258 | 1039 | -2435 | -2009 | 4185 | 9400% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 11(D) | -2498 | -4412 | 3500 | 1042 | -4581 | -2437 | -1765 | -4500 | 733 | -4361 | -3682 | 515 | -2961 | -1429 | -2799 | -2158 | -2558 | -3974 | -4550 | -3541 | 9500% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 12(K) | 11 | -2371 | 348 | 819 | -2692 | -535 | -527 | -2443 | 2294 | -2387 | -1461 | 590 | -1960 | -68 | 904 | -67 | -837 | -1993 | -2554 | -1871 | 9600% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 13(D) | -2663 | -4633 | 3700 | 580 | -4789 | -2487 | -1872 | -4738 | 731 | -4578 | -3963 | -1073 | -3046 | -1551 | -2987 | -2292 | -2742 | -4201 | -4759 | -3709 | 9700% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 14(C) | 2503 | 3193 | -4266 | -3818 | -2010 | -3276 | -2896 | 762 | -3517 | -1437 | -1051 | -3233 | -3509 | -3212 | -3411 | -2499 | -1792 | 1507 | -2796 | -2431 | 9800% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |
| 15(D) | -1363 | -2905 | 2748 | 542 | -3202 | -2072 | -920 | -2977 | 290 | -2912 | -2023 | 1270 | -2294 | -489 | -1186 | 53 | 1116 | -2518 | -3086 | -2349 | 9900% |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -8 | -8139 | -9181 | -894 | -1115 | -701 | -1378 | * | | | | | | | | | | | | | |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 16(L) | -1268 -149 -8 | -1113 -500 -8139 | -3338 233 -9181 | -540 43 -894 | -1057 -381 -1115 | -2827 399 -701 | -1716 106 -1378 | 569 -626 * | -2409 210 * | 2299 -466 | -236 -720 | -2381 275 | -2862 394 | -2089 45 | -2316 96 | -232 359 | -1213 117 | 1306 -369 | -1645 -294 | -1304 -249 | 10000% |
| 17(S) | -1350 -149 -2336 | -2877 -500 -8139 | 588 233 -325 | 1045 43 -894 | -3189 -381 -1115 | -496 399 -701 | -920 106 -1378 | -2963 -626 * | -628 210 * | -2901 -466 | -2011 -720 | 1860 275 | -2289 394 | -489 45 | -1184 96 | 2139 359 | 190 117 | -2503 -369 | -3077 -294 | -2343 -249 | 10100% |
| 18(G) | -454 -149 -38 | -832 -500 -5840 | -968 233 -6882 | -1110 43 -894 | -2112 -381 -1115 | 3143 399 -3098 | -1211 106 -1378 | -2091 -626 * | -1317 210 * | -2264 -466 | -1691 -720 | -978 275 | -1499 394 | -1202 45 | -1421 96 | -646 359 | -774 117 | -1550 -369 | -1916 -294 | -1919 -249 | 10200% |
| 19(H) | -898 -149 -38 | -1313 -500 -5840 | -545 233 -6882 | -482 43 -894 | -320 -381 -1115 | -1336 399 -3098 | 4297 106 -179 | -1552 -626 * | -160 210 * | -1493 -466 | -1035 -720 | -579 275 | -1675 394 | -363 45 | -322 96 | -934 359 | -951 117 | -1354 -369 | -725 -294 | 107 -249 | 10300% |
| 20(D) | -872 -149 -38 | -1812 -500 -5840 | 3234 233 -6882 | 432 43 -894 | -2215 -381 -1115 | -967 399 -3098 | -433 106 -179 | -2172 -626 * | -569 210 * | -2269 -466 | -1704 -720 | 99 275 | -1453 394 | -184 45 | -1141 96 | -728 359 | -973 117 | -1814 -369 | -2146 -294 | -1646 -249 | 10400% |
| 21(E) | -766 -149 -38 | -1695 -500 -5840 | 521 233 -6882 | 2831 43 -894 | -2050 -381 -1115 | -1029 399 -3098 | -293 106 -179 | -1804 -626 * | -118 210 * | -1919 -466 | -1331 -720 | 69 275 | -1441 394 | -4 45 | -527 96 | -653 359 | -814 117 | -1512 -369 | -1988 -294 | -1505 -249 | 10500% |
| 22(Y) | -1337 -149 -38 | -1229 -500 -5840 | -1681 233 -6882 | -1596 43 -894 | 1268 -381 -1115 | -1957 399 -109 | 121 106 -3775 | -918 -626 * | -1294 210 * | -769 -466 | -585 -720 | -1229 275 | -2163 394 | -1111 45 | -1301 96 | -1443 359 | -1359 117 | -932 -369 | 592 -294 | 3932 -249 | 10600% |
| 23(I) | -2294 -149 -8 | -1931 -501 -8139 | -4749 233 -9181 | -4227 43 -894 | -1724 -381 -1115 | -4227 399 -701 | -3320 106 -1378 | 2306 -626 * | -3952 210 * | 1990 -466 | -634 -720 | -3878 275 | 94 394 | -3538 45 | -3812 96 | -3411 359 | -2247 117 | 1576 -369 | -2891 -294 | -2629 -249 | 10700% |
| 24(I) | -2801 -149 -8 | -2299 -500 -8139 | -5406 233 -9181 | -5003 43 -894 | -2108 -381 -1115 | -5164 399 -701 | -4649 106 -1378 | 3051 -626 * | -4886 210 * | 1593 -466 | -869 -720 | -4829 275 | -4788 394 | -4454 45 | -4829 96 | -4493 359 | -2764 117 | 1435 -369 | -3781 -294 | -3585 -249 | 10800% |
| 25(K) | -234 -149 -8 | -2632 -500 -8139 | 306 233 -9181 | -500 43 -894 | -3007 -381 -1115 | -2141 399 -701 | -719 106 -1378 | -2712 -626 * | 2540 210 * | -2619 -466 | -1730 -720 | -778 275 | -2231 394 | 2257 45 | 968 96 | -1109 359 | -1152 117 | -2288 -369 | -2738 -294 | -2136 -249 | 10900% |
| 26(G) | -2184 -149 -155 | -3900 -500 -8139 | 796 233 -9181 | 392 42 -3674 | -4174 -375 -118 | 2903 399 -701 | -1580 104 -1378 | -4030 -625 * | -1636 210 * | -3937 -463 | -3173 -722 | -967 276 | -2810 396 | -1 44 | -2362 96 | 1069 358 | -2220 116 | -3530 -371 | -4130 -296 | -3229 -251 | 11000% |
| 27(K) | -3243 -149 -8 | -3775 -500 -3318 | -4129 233 -9181 | -2558 43 -894 | -4750 -381 -1115 | -3647 399 -701 | -1490 106 -1378 | -4021 -626 * | 3681 210 * | -3617 -466 | -2982 -720 | -2368 275 | -3580 394 | -1076 45 | 1318 96 | -3119 359 | -2876 117 | -3817 -369 | -3395 -294 | -3374 -249 | 12600% |
| 28(K) | -1684 -149 -8 | -2925 -500 -8139 | -1665 233 -9181 | -979 43 -894 | -3407 -381 -1115 | -2535 399 -701 | -923 106 -1378 | -3021 -626 * | 2737 210 * | -2865 -466 | -2032 -720 | 202 275 | -2582 394 | 1301 45 | 804 96 | -1564 359 | 1681 117 | -2645 -369 | -2905 -294 | -2448 -249 | 12700% |
| 29(V) | -2623 -149 -8 | -2122 -500 -8139 | -5300 233 -9181 | -4990 43 -894 | -2769 -381 -1115 | -5101 399 -701 | -5131 106 -1378 | 2388 -626 * | -4945 210 * | -1532 -466 | -1474 -720 | -4790 275 | -4868 394 | -4890 45 | -5101 96 | -4482 359 | -2619 117 | 3219 -369 | -4505 -294 | -3990 -249 | 12800% |
| 30(A) | 3309 -149 -8 | -1828 -500 -8139 | -4057 233 -9181 | -4294 43 -894 | -4382 -381 -1115 | 656 399 -701 | -3657 106 -1378 | -4147 -626 * | -4169 210 * | -4428 -466 | -3497 -720 | -2821 275 | -2904 394 | -3694 45 | -3937 96 | -1470 359 | 59 117 | -2957 -369 | -4610 -294 | -4522 -249 | 12900% |
| 31(V) | -2625 -149 -8 | -2122 -500 -8139 | -5304 233 -9181 | -4993 43 -894 | -2772 -381 -1115 | -5111 399 -701 | -5142 106 -1378 | 2881 -626 * | -4950 210 * | -1532 -466 | -1474 -720 | -4796 275 | -4873 394 | -4896 45 | -5108 96 | -4492 359 | -2621 117 | 2896 -369 | -4512 -294 | -3997 -249 | 13000% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 32(I) | -2790 -149 -8 | -2287 -500 -8139 | -5403 233 -9181 | -5009 43 -894 | -2155 -381 -1115 | -5170 399 -701 | -4698 106 -1378 | 3324 -626 * | -4899 210 * | 1175 -466 | -912 -720 | -4835 275 | -4802 394 | -4495 45 | -4860 96 | -4506 359 | -2757 117 | 1192 -369 | -3838 -294 | -3622 -249 | 13100% |
| 33(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 13200% |
| 34(Y) | -4838 -149 -8 | -3766 -500 -8139 | -5229 233 -9181 | -5579 43 -894 | 1502 -381 -1115 | -5108 399 -701 | -1300 106 -1378 | -3726 -626 * | -5134 210 * | -3040 -466 | -3131 -720 | -3723 275 | -4963 394 | -3861 45 | -4500 96 | -4356 359 | -4689 117 | -3881 -369 | 2986 -294 | 4507 -249 | 13300% |
| 35(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 13400% |
| 36(S) | -1473 -149 -8 | -2007 -500 -8139 | -3647 233 -9181 | -3780 43 -894 | -3430 -381 -1115 | -2363 399 -701 | -3314 106 -1378 | 228 -626 * | -3616 210 * | -3373 -466 | -2876 -720 | -2840 275 | -3093 394 | -3395 45 | -3541 96 | 3475 359 | -1885 117 | -2307 -369 | -3927 -294 | -3474 -249 | 13500% |
| 37(Q) | -4589 -149 -8 | -4392 -500 -8139 | -3927 233 -9181 | -4146 43 -894 | -5099 -381 -1115 | -4221 399 -701 | -4099 106 -1378 | -5973 -626 * | -3840 210 * | -5564 -466 | -5304 -720 | -4230 275 | -4693 394 | 4575 45 | -3826 96 | -4704 359 | -4772 117 | -5612 -369 | -4577 -294 | -4751 -249 | 13600% |
| 38(G) | 677 -149 -8 | -2128 -500 -8139 | -3838 233 -9181 | -4171 43 -894 | -4647 -381 -1115 | 3536 399 -701 | -3816 106 -1378 | -4506 -626 * | -4340 210 * | -4749 -466 | -3857 -720 | -3009 275 | -3149 394 | -3871 45 | -4137 96 | -1784 359 | -2005 117 | -3297 -369 | -4725 -294 | -4735 -249 | 13700% |
| 39(H) | -2667 -149 -8 | -3375 -500 -8139 | -2682 233 -9181 | -2114 43 -894 | -3744 -381 -1115 | -3201 399 -701 | 4738 106 -1378 | -3782 -626 * | -445 210 * | -3553 -466 | -2886 -720 | -2112 275 | 866 394 | -1265 45 | 1506 96 | -2614 359 | -2557 117 | -3469 -369 | -3282 -294 | -2908 -249 | 13800% |
| 40(A) | 3631 -149 -8 | -2768 -500 -8139 | -4492 233 -9181 | -4815 43 -894 | -4888 -381 -1115 | -2992 399 -701 | -4271 106 -1378 | -4781 -626 * | -4818 210 * | -5025 -466 | -4365 -720 | -3727 275 | -3728 394 | -4477 45 | -4545 96 | -2567 359 | -2762 117 | -3852 -369 | -4724 -294 | -4942 -249 | 13900% |
| 41(H) | -3103 -149 -8 | -3404 -500 -8139 | -2950 233 -9181 | -2573 43 -894 | -783 -381 -1115 | -3679 399 -701 | 4549 106 -1378 | -3407 -626 * | -1372 210 * | -3071 -466 | -2715 -720 | -2454 275 | -3764 394 | 2546 45 | -1428 96 | -2990 359 | -2976 117 | -3308 -369 | 2269 -294 | -295 -249 | 14000% |
| 42(A) | 3357 -149 -8 | -1795 -500 -8139 | -4134 233 -9181 | -4277 43 -894 | -4057 -381 -1115 | -2118 399 -701 | -3548 106 -1378 | -3549 -626 * | -4035 210 * | -4024 -466 | -3192 -720 | -2817 275 | -2900 394 | -3608 45 | -3823 96 | 217 359 | -1660 117 | -276 -369 | -4363 -294 | -4211 -249 | 14100% |
| 43(Q) | -1061 -149 -8 | 1950 -500 -8139 | -2044 233 -9181 | -1475 43 -894 | -1236 -381 -1115 | -2372 399 -701 | -1154 106 -1378 | -789 -626 * | -1218 210 * | 1062 -466 | 1123 -720 | 743 275 | -2446 394 | 2895 45 | -1441 96 | -1392 359 | -1005 117 | -693 -369 | -1678 -294 | -1278 -249 | 14200% |
| 44(N) | -4000 -149 -8 | -4117 -500 -8139 | -3389 233 -9181 | -3749 43 -894 | -5073 -381 -1115 | -3911 399 -701 | -4123 106 -1378 | -6022 -626 * | -4503 210 * | -5797 -466 | -5419 -720 | 4397 275 | -4479 394 | -4255 45 | -4592 96 | -4115 359 | -4312 117 | -5371 -369 | -4650 -294 | -4731 -249 | 14300% |
| 45(L) | -4414 -149 -8 | -3800 -500 -8139 | -5638 233 -9181 | -5628 43 -894 | -2290 -381 -1115 | -4980 399 -701 | -4628 106 -1378 | -1886 -626 * | -5423 210 * | 3316 -466 | -1236 -720 | -5514 275 | -4997 394 | -4750 45 | -5002 96 | -5379 359 | -4399 117 | -2629 -369 | -3665 -294 | -3690 -249 | 14400% |
| 46(R) | -1731 -149 -8 | -3015 -500 -8139 | 275 233 -9181 | -931 43 -894 | -3487 -381 -1115 | -2518 399 -701 | -973 106 -1378 | -3116 -626 * | 2321 210 * | -2955 -466 | -2123 -720 | 224 275 | -2603 394 | 256 45 | 2808 96 | -1596 359 | -1613 117 | -2730 -369 | -2995 -294 | -2515 -249 | 14500% |
| 47(D) | -2896 -149 -8 | -4843 -500 -8139 | 3855 233 -9181 | 944 43 -894 | -5037 -381 -1115 | -2600 399 -701 | -2082 106 -1378 | -5082 -626 * | -2528 210 * | -4903 -466 | -4373 -720 | -1209 275 | -3196 394 | -1786 45 | -3536 96 | -2501 359 | -3007 117 | -4517 -369 | -5004 -294 | -3956 -249 | 14600% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 48(S) | -1536 -148 -155 -8 | -2212 -500 -3318 -8139 | -2363 232 -9181 | -2679 44 -2405 -894 | -4293 -381 -302 -1115 | -2279 398 -701 | -3082 105 -1378 | -4365 -627 * | -3331 211 * | -4524 -465 | -3676 -721 | 288 275 | -3026 393 | -2967 45 | -3497 95 | 3508 360 | -1962 118 | -3259 -370 | -4477 -295 | -4066 -250 | 14700% |
| 49(G) | -2521 -149 -8 | -3968 -500 -8139 | 1232 233 -9181 | -911 43 -894 | -4849 -381 -1115 | 3373 399 -701 | -2126 106 -1378 | -4854 -626 * | -2535 210 * | -4752 -466 | -4136 -720 | -53 275 | -3115 394 | -1836 45 | -3440 96 | -2284 359 | -2716 117 | -4157 -369 | -4880 -294 | -3914 -249 | 15400% |
| 50(V) | -2767 -148 -8 | -2324 -500 -8139 | -5232 233 -9181 | -4770 43 -894 | 396 -381 -1115 | -4827 399 -701 | -3784 106 -1378 | -36 -626 * | -4546 211 * | 848 -466 | -611 -720 | -4472 275 | -4518 394 | -3980 45 | -4367 96 | -4081 359 | -2716 117 | 3323 -369 | -3037 -294 | -2660 -249 | 15500% |
| 51(D) | -1684 -148 -8 | -3285 -500 -8139 | 2735 233 -9181 | -203 2014 43 -894 | -2928 -3554 -381 -1115 | -2196 399 -701 | -1177 106 -1378 | -3350 -626 * | 92 210 * | -3279 -466 | -2427 -720 | 692 275 | -2505 394 | -770 45 | -1595 96 | -1483 359 | -1666 117 | 332 -369 | -3460 -294 | -2676 -249 | 15700% |
| 52(V) | -3122 -149 -8 | -2888 -500 -8139 | -5092 233 -9181 | -5160 43 -894 | -3522 -381 -1115 | -4180 399 -701 | -4687 106 -1378 | -905 -626 * | -5060 210 * | -2626 -466 | -2570 -720 | -4662 275 | -4579 394 | -4940 45 | -4923 96 | -4013 359 | -3297 117 | 3796 -369 | -4414 -294 | -4190 -249 | 15800% |
| 53(V) | 369 -149 -8 | 366 -500 -8139 | -3075 233 -9181 | -2462 43 -894 | -883 -381 -1115 | -2557 399 -701 | -1420 106 -1378 | 1415 -626 * | 378 210 * | -757 -466 | -117 -720 | -2098 275 | -2610 394 | -1809 45 | -2037 96 | -1630 359 | 1166 117 | 2145 -369 | -1385 -294 | -343 -249 | 15900% |
| 54(V) | -2624 -149 -8 | -2122 -500 -8139 | -5302 233 -9181 | -4991 43 -894 | -2772 -381 -1115 | -5108 399 -701 | -5139 106 -1378 | 2623 -626 * | -4948 210 * | -1533 -466 | -1475 -720 | -4794 275 | -4871 394 | -4894 45 | -5106 96 | -4488 359 | -2620 117 | 3088 -369 | -4511 -294 | -3996 -249 | 16000% |
| 55(G) | 929 -149 -8 | -2107 -500 -8139 | -3852 233 -9181 | -4182 43 -894 | -4633 -381 -1115 | 3492 399 -701 | -3809 106 -1378 | -4486 -626 * | -4335 210 * | -4732 -466 | -3835 -720 | -2997 275 | -3132 394 | -3863 45 | -4127 96 | -1761 359 | -1982 117 | -3275 -369 | -4720 -294 | -4725 -249 | 16100% |
| 56(L) | -3427 -149 -8 | -2938 -500 -8139 | -5791 233 -9181 | -5325 43 -894 | -1449 -381 -1115 | -5374 399 -701 | -4410 106 -1378 | -543 -626 * | -5063 210 * | 3041 -466 | -255 -720 | -5207 275 | -4820 394 | -4126 45 | -4691 96 | -4757 359 | -3351 117 | 883 -369 | -3184 -294 | -3234 -249 | 16200% |
| 57(R) | -3040 -149 -8 | -3724 -500 -8139 | -3266 233 -9181 | 82 43 -894 | -4620 -381 -1115 | -3470 399 -701 | -1396 106 -1378 | -3905 -626 * | 804 210 * | -3529 -466 | -2874 -720 | -2133 275 | -3439 394 | -978 45 | 3800 96 | -2894 359 | -2709 117 | -3682 -369 | -3353 -294 | -3267 -249 | 16300% |
| 58(K) | 31 -149 -8 | -2412 -500 -8139 | -803 233 -9181 | 1532 43 -894 | -2743 -381 -1115 | -1920 399 -701 | -559 106 -1378 | -2483 -626 * | 1772 210 * | -2421 -466 | -1503 -720 | -556 275 | 1229 394 | 727 45 | 1079 96 | -566 359 | -893 117 | -2041 -369 | -2579 -294 | -1915 -249 | 16400% |
| 59(G) | -2671 -149 -8 | -4661 -500 -8139 | 1614 233 -9181 | 587 43 -894 | -4832 -381 -1115 | 3103 399 -701 | -1901 106 -1378 | -4803 -626 * | -2269 210 * | -4648 -466 | -4047 -720 | 421 275 | -3049 394 | -1587 45 | -3230 96 | -2297 359 | -2766 117 | -4245 -369 | -4850 -294 | -3752 -249 | 16500% |
| 60(S) | -1499 -149 -247 -8 | -2308 -500 -8139 | -1932 233 -9181 | -1859 43 -894 | -4006 -381 -1115 | 1604 399 -701 | -2121 106 -1378 | -3754 -626 * | 1362 210 * | -3793 -466 | -2945 -720 | -1833 275 | -2827 394 | -1794 45 | -1902 96 | 2738 359 | -1771 117 | -2970 -369 | -3910 -294 | -3479 -249 | 16600% |
| 61(K) | 1362 -149 -9 | -2232 -500 -7900 | -2699 233 -8943 | -98 43 -894 | -2567 -381 -1115 | -427 399 -701 | -435 106 -1378 | -2309 -626 * | 1599 210 * | -2265 -466 | -1349 -720 | 1101 275 | -1861 394 | 886 45 | -512 96 | 833 359 | -740 117 | -1868 -369 | -2441 -294 | -1767 -249 | 16700% |
| 62(S) | -1288 -149 -8 | -1904 -500 -8139 | -3742 233 -9181 | -4011 43 -894 | -4384 -381 -1115 | -2155 -344 399 -701 | -2238 -3593 106 -1378 | -4209 -626 * | -3996 210 * | -4479 -466 | -3573 -720 | -2789 275 | -2948 394 | -3606 45 | -3832 96 | 3517 359 | 228 117 | -3028 -369 | -4600 -294 | -4451 -249 | 16800% |
| 63(W) | 726 -149 -8 | -873 -500 -8139 | -3261 233 -9181 | -2634 43 -894 | 1926 -381 -1115 | -2567 399 -701 | -1425 106 -1378 | 660 -626 * | -2252 210 * | -701 -466 | -68 -720 | -2174 275 | -2617 394 | -1898 45 | 18 96 | -1648 359 | -972 117 | 983 -369 | 4091 -294 | -958 -249 | 16900% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 64(E) | 1527 -149 -8 | -2404 -500 -8139 | 212 233 -9181 | 1636 43 -894 | -2722 -381 -1115 | -1878 399 -701 | -556 106 -1378 | -2474 -626 * | 1241 210 * | -2419 -466 | -1497 -720 | 350 275 | -1985 394 | -100 45 | -659 96 | 96 359 | 70 117 | -2025 -369 | -2589 -294 | -1903 -249 | 17000% |
| 65(K) | -8 -149 -8 | -2242 -500 -8139 | -895 233 -9181 | 770 43 -894 | -2502 -381 -1115 | -1963 399 -701 | -609 106 -1378 | -2192 -626 * | 2589 210 * | 22 -466 | -1353 -720 | -631 275 | -2052 394 | 692 45 | -617 96 | -889 359 | -906 117 | -361 -369 | -2455 -294 | -1836 -249 | 17100% |
| 66(A) | 3631 -149 -8 | -2768 -500 -8139 | -4492 233 -9181 | -4815 43 -894 | -4888 -381 -1115 | -2992 399 -701 | -4271 106 -1378 | -4781 -626 * | -4818 210 * | -5025 -466 | -4365 -720 | -3727 275 | -3728 394 | -4477 45 | -4545 96 | -2567 359 | -2762 117 | -3852 -369 | -4724 -294 | -4942 -249 | 17200% |
| 67(Q) | -1006 -149 -8 | -2441 -500 -8139 | -869 233 -9181 | 1767 43 -894 | -2780 -381 -1115 | -1965 399 -701 | -586 106 -1378 | -2510 -626 * | 1702 210 * | -2445 -466 | -1534 -720 | -603 275 | -2052 394 | 1923 45 | 873 96 | -888 359 | 236 117 | -630 -369 | -2596 -294 | -1949 -249 | 17300% |
| 68(A) | 1489 -149 -8 | -2393 -500 -8139 | 167 233 -9181 | 1234 43 -894 | -2711 -381 -1115 | -1873 399 -701 | -547 106 -1378 | -2462 -626 * | 895 210 * | -2408 -466 | -1485 -720 | 1161 275 | -1977 394 | -90 45 | -648 96 | 666 359 | 141 117 | -2014 -369 | -2577 -294 | -1892 -249 | 17400% |
| 69(D) | 2104 -149 -8 | -2898 -500 -8139 | 2124 233 -9181 | 985 43 -894 | -3163 -381 -1115 | -2096 399 -701 | 1397 106 -1378 | -2935 -626 * | -693 210 * | -2897 -466 | -2025 -720 | -723 275 | -2329 394 | -543 45 | -1250 96 | -1245 359 | -1368 117 | -2501 -369 | -3087 -294 | -530 -249 | 17500% |
| 70(G) | -2294 -149 -8 | -2898 -500 -8139 | -2521 233 -9181 | -2885 43 -894 | -4852 -381 -1115 | 3641 399 -701 | -3456 106 -1378 | -5042 -626 * | -3796 210 * | -5094 -466 | -4356 -720 | 365 275 | -3545 394 | -3376 45 | -4005 96 | -2451 359 | -2700 117 | -3996 -369 | -4706 -294 | -4575 -249 | 17600% |
| 71(F) | -2596 -149 -8 | -2266 -500 -8139 | -4685 233 -9181 | -4188 43 -894 | 3199 -381 -1115 | -4136 399 -701 | 1018 106 -1378 | 505 -626 * | -3812 210 * | 1986 -466 | -405 -720 | -3595 275 | -3961 394 | -3157 45 | -3524 96 | -3277 359 | -2509 117 | -1337 -369 | -1621 -294 | -840 -249 | 17700% |
| 72(K) | 47 -149 -8 | -2348 -500 -8139 | 338 233 -9181 | 950 43 -894 | -2668 -381 -1115 | -1854 399 -701 | -512 105 -1378 | -507 -627 * | 1721 210 * | -2364 -466 | -1438 -721 | -490 277 | -1947 393 | 672 45 | 436 95 | 806 359 | 687 119 | -1970 -370 | -2533 -295 | -1851 -250 | 17800% |
| 73(V) | -1810 -149 -155 | -3318 -500 -8139 | 232 233 -9181 | 46 43 -894 | -366 -381 -1115 | -2618 399 -701 | -1496 106 -1378 | 1052 -626 * | -2198 210 * | -792 -466 | 1859 -720 | -146 275 | 686 394 | -1884 45 | -2111 96 | -1695 359 | 945 117 | 2346 -369 | -1458 -294 | -1106 -249 | 18400% |
| 74(K) | 1606 -149 -8 | -2321 -500 -8139 | -752 233 -9181 | 612 43 -894 | -1869 -381 -1115 | -3417 399 -701 | -527 105 -1378 | -2366 -626 * | 1480 210 * | -2331 -466 | -1416 -720 | -510 275 | -789 394 | -73 45 | 421 96 | 23 359 | -829 117 | -1936 -369 | 2212 -294 | -1843 -249 | 18500% |
| 75(T) | 847 -149 -8 | -1093 -500 -8139 | -2131 233 -9181 | -1554 43 -894 | 304 -381 -1115 | 127 399 -701 | -1127 106 -1378 | -637 -626 * | 1445 210 * | 645 -466 | 1186 -720 | -1534 275 | -2401 394 | -1174 45 | -1547 96 | -764 359 | -172 117 | -528 -369 | -1519 -294 | 1413 -249 | 18600% |
| 76(V) | -1284 -149 -8 | -2794 -500 -8139 | 1526 233 -9181 | 1290 43 -894 | -3096 -381 -1115 | -2041 399 -701 | 1289 106 -1378 | -2863 -626 * | -548 210 * | -2808 -466 | -1914 -720 | -668 275 | -2242 394 | -427 45 | -1095 96 | 1451 359 | 1827 117 | -2411 -369 | -2986 -294 | -2264 -249 | 18700% |
| 77(W) | -1089 -149 -8 | -957 -500 -8139 | -3143 233 -9181 | -2535 43 -894 | -943 -381 -1115 | -2618 399 -701 | -1496 106 -1378 | -2863 -626 * | -2198 210 * | -792 -466 | 1859 -720 | -146 275 | 686 394 | -1884 45 | -2111 96 | -1695 359 | 945 117 | 2346 -369 | -1458 -294 | -1106 -249 | 18800% |
| 78(E) | -1509 -149 -8 | -3540 -500 -8139 | 1372 233 -9181 | 3127 43 -894 | -3861 -381 -1115 | -120 399 -701 | -1391 106 -1378 | -3685 -626 * | -1319 210 * | -3605 -466 | -2787 -720 | -900 275 | -2659 394 | -1005 45 | -1976 96 | -400 359 | -655 117 | -3194 -369 | -3790 -294 | -2957 -249 | 18900% |
| 79(A) | 3390 -149 -8 | -1868 -500 -8139 | -4092 233 -9181 | -4341 43 -894 | -4332 -381 -1115 | -2153 399 -701 | -3680 106 -1378 | -3942 -626 * | -4157 210 * | -4333 -466 | -3471 -720 | -2869 275 | -2948 394 | -3730 45 | -3919 96 | -1525 359 | 931 117 | -2894 -369 | -4580 -294 | -4483 -249 | 19000% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 80(V) | 2003 -149 -8 | -1721 -500 -8139 | -4449 233 -9181 | -3995 43 -894 | -2160 -381 -1115 | -3763 399 -701 | -3240 106 -1378 | 1342 -626 * | -3745 210 * | -1435 -466 | -1124 -720 | -3561 275 | -3855 394 | -3494 45 | -3700 96 | -2979 359 | -58 117 | 2574 -369 | -3091 -294 | -2698 -249 | 19100% |
| 81(K) | 1714 -149 -8 | -2501 -500 -8139 | -959 233 -9181 | 446 43 -894 | -2858 -381 -1115 | -2043 399 -701 | -654 106 -1378 | -2574 -626 * | 1964 210 * | -2506 -466 | -1609 -720 | -689 275 | -2135 394 | -203 45 | 1088 96 | 428 359 | -1032 117 | -2148 -369 | -2652 -294 | -2027 -249 | 19200% |
| 82(W) | 265 -149 -8 | -2347 -500 -8139 | 815 233 -9181 | 432 43 -894 | -2663 -381 -1115 | 634 399 -701 | -519 106 -1378 | -2410 -626 * | 619 210 * | -2361 -466 | -1438 -720 | -495 275 | -1952 394 | 1955 45 | -609 96 | -382 359 | 147 117 | -1966 -369 | 2858 -294 | -1853 -249 | 19300% |
| 83(A) | 3391 -149 -8 | -1860 -500 -8139 | -3998 233 -9181 | -4279 43 -894 | -4411 -381 -1115 | -2128 399 -701 | -3684 106 -1378 | -4207 -626 * | -4197 210 * | -4490 -466 | -3565 -720 | -2837 275 | -2929 394 | -3729 45 | -3959 96 | 706 359 | -1718 117 | -3001 -369 | -4636 -294 | -4534 -249 | 19400% |
| 84(D) | -2747 -149 -8 | -4795 -500 -8139 | 3813 233 -9181 | 396 43 -894 | -4912 -381 -1115 | -2496 399 -701 | -1935 106 -1378 | -4905 -626 * | -2324 210 * | -4735 -466 | -4166 -720 | -1079 275 | -3082 394 | 603 45 | -3296 96 | -2353 359 | -2844 117 | -4347 -369 | -4929 -294 | -3809 -249 | 19500% |
| 85(V) | -2717 -149 -8 | -2220 -500 -8139 | -5338 233 -9181 | -4951 43 -894 | -2254 -381 -1115 | -5099 399 -701 | -4670 106 -1378 | 1963 -626 * | -4844 210 * | 1553 -466 | -1011 -720 | -4759 275 | -4771 394 | -4509 45 | -4836 96 | -4427 359 | -2688 117 | 2741 -369 | -3899 -294 | -3628 -249 | 19600% |
| 86(V) | -2635 -149 -8 | -2129 -500 -8139 | -5306 233 -9181 | -4970 43 -894 | -2652 -381 -1115 | -5125 399 -701 | -5011 106 -1378 | 2554 -626 * | -4915 210 * | -354 -466 | -1368 -720 | -4781 275 | -4852 394 | -4798 45 | -5038 96 | -4487 359 | -2622 117 | 3019 -369 | -4355 -294 | -3902 -249 | 19700% |
| 87(M) | -1340 -149 -8 | -1208 -500 -8139 | -3317 233 -9181 | -2708 43 -894 | -968 -381 -1115 | -2860 399 -701 | -1708 106 -1378 | 577 -626 * | -2346 210 * | 932 -466 | 4131 -720 | -2382 275 | -2878 394 | 250 45 | -2265 96 | -228 359 | -1278 117 | -506 -369 | -1629 -294 | -1313 -249 | 19800% |
| 88(I) | -2566 -149 -8 | -2177 -500 -8139 | -5017 233 -9181 | -4470 43 -894 | 669 -381 -1115 | -4496 399 -701 | -3487 106 -1378 | 2791 -626 * | -4191 210 * | 1116 -466 | 1394 -720 | -4156 275 | -4228 394 | -3615 45 | -3972 96 | -3687 359 | -2499 117 | 1692 -369 | -2860 -294 | -2711 -249 | 19900% |
| 89(L) | -4414 -149 -8 | -3800 -500 -8139 | -5638 233 -9181 | -5628 43 -894 | -2290 -381 -1115 | -4980 399 -701 | -4628 106 -1378 | -1886 -626 * | -5423 210 * | 3316 -466 | -1236 -720 | -5514 275 | -4997 394 | -4750 45 | -5002 96 | -5379 359 | -4399 117 | -2629 -369 | -3665 -294 | -3690 -249 | 20000% |
| 90(I) | 1212 -149 -8 | -1286 -500 -8139 | -3846 233 -9181 | -3262 43 -894 | -1360 -381 -1115 | -3195 399 -701 | -2166 106 -1378 | 1616 -626 * | -2918 210 * | 1031 -466 | -493 -720 | -2824 275 | -3211 394 | -2583 45 | -2782 96 | -2308 359 | 1598 117 | 1299 -369 | -2020 -294 | -1668 -249 | 20100% |
| 91(P) | -1614 -149 -8 | -2214 -500 -8139 | -3396 233 -9181 | -3710 43 -894 | -4516 -381 -1115 | -2407 399 -701 | -3618 106 -1378 | -4516 -626 * | -3976 210 * | -4705 -466 | -3849 -720 | -2890 275 | 3993 394 | -3625 45 | -3900 96 | 666 359 | -2068 117 | -3354 -369 | -4610 -294 | -4474 -249 | 20200% |
| 92(D) | -4580 -149 -8 | -4701 -500 -8139 | 4174 233 -9181 | -3014 43 -894 | -5700 -381 -1115 | -3967 399 -701 | -3905 106 -1378 | -6376 -626 * | -4478 210 * | -6024 -466 | -5744 -720 | -3355 275 | -4501 394 | -3870 45 | -4926 96 | -4440 359 | -4750 117 | -5894 -369 | -4922 -294 | -5231 -249 | 20300% |
| 93(E) | -1123 -149 -8 | -2199 -500 -8139 | -983 233 -9181 | 2715 43 -894 | -2589 -381 -1115 | -2046 399 -701 | -942 106 -1378 | -2250 -626 * | -625 210 * | -2356 -466 | 1979 -720 | -870 275 | -2250 394 | -554 45 | -1093 96 | 4440 359 | 932 117 | -1902 -369 | -2660 -294 | -2064 -249 | 20400% |
| 94(H) | 399 -149 -8 | -1137 -500 -8139 | -2012 233 -9181 | -14 43 -894 | 1582 -381 -1115 | -2306 399 -701 | 1600 106 -1378 | 246 -626 * | -1252 210 * | 190 -466 | -325 -720 | -1456 275 | -2374 394 | 1474 45 | -1479 96 | -94 359 | -905 117 | 896 -369 | -1557 -294 | -1158 -249 | 20500% |
| 95(Q) | -2742 -149 -8 | -3142 -500 -8139 | -2766 233 -9181 | -2681 43 -894 | -2790 -381 -1115 | -3344 399 -701 | -2460 106 -1378 | -160 -626 * | -1802 210 * | -2456 -466 | -2353 -720 | -2682 275 | -3710 394 | 4317 45 | -1866 96 | -2894 359 | -2844 117 | -2559 -369 | -3295 -294 | -2711 -249 | 20600% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 96(A) | 1981 -149 -8 | -2315 -500 -8139 | -809 233 -9181 | -268 43 -894 | -2645 -381 -1115 | -531 399 -701 | -579 106 -1378 | -2374 -626 * | 232 210 * | -2350 -466 | -1445 -720 | -567 275 | 1217 394 | 711 45 | 445 96 | 447 359 | -874 117 | -1951 -369 | -2540 -294 | -1883 -249 | 20700% |
| 97(D) | 491 -149 -8 | -2351 -500 -8139 | 1394 233 -9181 | 1381 43 -894 | -2671 -381 -1115 | -1854 399 -701 | 1062 106 -1378 | -2421 -626 * | 1010 210 * | -2367 -466 | -1440 -720 | -489 275 | -1947 394 | 1017 45 | 362 96 | -760 359 | 250 117 | -623 -369 | -2535 -294 | -1852 -249 | 20800% |
| 98(V) | -2039 -149 -8 | -1706 -500 -8139 | -4456 233 -9181 | -3939 43 -894 | -1846 -381 -1115 | -3939 399 -701 | -3049 106 -1378 | 1986 -626 * | -3656 210 * | 1460 -466 | -826 -720 | 804 275 | -3870 394 | -3351 45 | -3565 96 | -3105 359 | -2000 117 | 2330 -369 | -2796 -294 | -2442 -249 | 20900% |
| 99(Y) | -4840 -149 -8 | -3766 -500 -8139 | -5230 233 -9181 | -5581 43 -894 | 1898 -381 -1115 | -5109 399 -701 | -1300 106 -1378 | -3727 -626 * | -5135 210 * | -3041 -466 | -3132 -720 | -3723 275 | -4964 394 | -3861 45 | -4501 96 | -4357 359 | -4690 117 | -3883 -369 | 3325 -294 | 4377 -249 | 21000% |
| 100(E) | -163 -149 -257 | -2353 -500 -8139 | -734 233 -9181 | 1681 43 -894 | -2674 -381 -1115 | -1859 399 -701 | 888 106 -1378 | -2422 -626 * | 1668 210 * | -792 -466 | -1443 -720 | 777 275 | -1952 394 | 890 45 | 286 96 | -766 359 | 238 117 | -1975 -369 | -2536 -294 | -1856 -249 | 21100% |
| 101(E) | 1017 -149 -8 | -2763 -500 -8139 | 862 233 -2649 | 2042 43 -894 | -3060 -381 -1115 | -1913 399 -701 | -775 106 -1378 | -2836 -626 * | -495 210 * | -2773 -466 | -1886 -720 | 1956 275 | -2143 394 | -136 45 | -1056 96 | 265 359 | -1185 117 | -2377 -369 | -2948 -294 | -2207 -249 | 21200% |
| 102(E) | -944 -149 -9 | -2422 -500 -8139 | -8933 233 -7891 | 2138 43 -894 | -2740 -381 -1115 | -436 399 -338 | -567 106 -2261 | -2493 -626 * | 894 210 * | -2437 -466 | -1515 -720 | -518 275 | -1994 394 | 1767 45 | -673 96 | 109 359 | -885 117 | -1023 -369 | -2605 -294 | -1917 -249 | 21300% |
| 103(I) | -2660 -149 -8 | -2156 -500 -8139 | -5316 233 -9181 | -4965 43 -894 | -2520 -381 -1115 | -5119 399 -701 | -4900 106 -1378 | 3165 -626 * | -4894 210 * | 297 -466 | -1251 -720 | -4775 275 | -4828 394 | -4705 45 | -4975 96 | -4470 359 | -2642 117 | 2240 -369 | -4202 -294 | -3814 -249 | 21400% |
| 104(E) | 1068 -149 -8 | -2341 -500 -8139 | -760 233 -9181 | 2003 43 -894 | 628 -381 -1115 | -1887 399 -701 | 876 106 -1378 | -2380 -626 * | 1240 210 * | -2347 -466 | -1436 -720 | -529 275 | -1983 394 | 881 45 | -618 96 | -804 359 | -855 117 | -1954 -369 | -2530 -294 | -1862 -249 | 21500% |
| 105(P) | -343 -149 -8 | -3144 -500 -8139 | 1561 233 -9181 | 442 43 -894 | -3538 -381 -1115 | -489 399 -701 | -1216 106 -1378 | -3329 -626 * | -1038 210 * | -3274 -466 | -2420 -720 | -848 275 | 2974 394 | -812 45 | -1635 96 | 469 359 | -1644 117 | -2849 -369 | -3462 -294 | -2693 -249 | 21600% |
| 106(N) | -1173 -149 -8 | -2375 -500 -8139 | -814 233 -9181 | 827 43 -894 | -2376 -381 -1115 | -2071 399 -701 | 1767 106 -1378 | -2279 -626 * | -479 210 * | -2336 -466 | -1509 -720 | 3151 275 | -2218 394 | -415 45 | -957 96 | -1093 359 | -1120 117 | -198 -369 | -2486 -294 | 647 -249 | 21700% |
| 107(M) | -3415 -149 -8 | -2890 -500 -8139 | -5826 233 -9181 | -5252 43 -894 | -1352 -381 -1115 | -5488 399 -701 | -4282 106 -1378 | 1361 -626 * | -5022 210 * | 2621 -466 | 2728 -720 | -5181 275 | -4778 394 | -4005 45 | -4613 96 | -4776 359 | -3292 117 | 69 -369 | -3071 -294 | -3194 -249 | 21800% |
| 108(K) | -1941 -149 -8 | -3098 -500 -8139 | -1997 233 -9181 | -1232 43 -894 | -3650 -381 -1115 | -2740 399 -701 | -1025 106 -1378 | -3210 -626 * | 3059 210 * | -3010 -466 | -2208 -720 | 499 275 | -2766 394 | 1457 45 | 1261 96 | -1817 359 | -90 117 | -2858 -369 | -3002 -294 | -2622 -249 | 21900% |
| 109(P) | 1129 -149 -8 | -2426 -500 -8139 | -740 233 -9181 | 964 43 -894 | -2747 -381 -1115 | -1913 399 -701 | -589 106 -1378 | -2491 -626 * | 1139 210 * | -2440 -466 | -1525 -720 | -552 275 | 1941 394 | 1446 45 | -655 96 | -480 359 | -913 117 | -2050 -369 | -2610 -294 | -1935 -249 | 22000% |
| 110(G) | -2276 -149 -8 | -2907 -500 -8139 | -2347 233 -9181 | -2709 43 -894 | -4832 -381 -1115 | 3554 399 -701 | -3349 106 -1378 | -5005 -626 * | -3678 210 * | -5053 -466 | -4315 -720 | 1193 275 | -3507 394 | -3243 45 | -3937 96 | -2418 359 | -2674 117 | -3974 -369 | -4703 -294 | -4521 -249 | 22100% |
| 111(A) | 1730 -149 -8 | -2349 -500 -8139 | 958 233 -9181 | -198 43 -894 | -2661 -381 -1115 | -1868 399 -701 | -535 106 -1378 | -2405 -626 * | 927 210 * | -2362 -466 | -1444 -720 | 414 275 | -1966 394 | 788 45 | -630 96 | 790 359 | -840 117 | -303 -369 | -2540 -294 | -1863 -249 | 22200% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 112(T) | 1350 -149 -8 | -1149 -500 -8139 | -14 233 -9181 | -1461 43 -894 | -1155 -381 -1115 | -2314 399 -701 | -1111 106 -1378 | 758 -626 * | -1275 210 * | -1024 -466 | 1167 -720 | -1475 275 | -2388 394 | -1111 45 | -1501 96 | 334 359 | 1843 117 | 354 -369 | -1581 -294 | -1182 -249 | 22300% |
| 113(L) | -3333 -149 -8 | -2796 -500 -8139 | -5806 233 -9181 | -5293 43 -894 | -1506 -381 -1115 | -5535 399 -701 | -4502 106 -1378 | 1096 -626 * | -5103 210 * | 2935 -466 | -282 -720 | -5232 275 | -4857 394 | -4172 45 | -4762 96 | -4864 359 | -3236 117 | 506 -369 | -3264 -294 | -3351 -249 | 22400% |
| 114(A) | 1769 -149 -8 | -1525 -500 -8139 | 158 233 -9181 | -857 43 -894 | -1603 -381 -1115 | 148 399 -701 | -891 106 -1378 | -1181 -626 * | -752 210 * | 187 -466 | -712 -720 | -1040 275 | -2228 394 | 660 45 | -1135 96 | -1111 359 | -913 117 | 1305 -369 | -1913 -294 | -1442 -249 | 22500% |
| 115(F) | -4110 -149 -8 | -3437 -500 -8139 | -5436 233 -9181 | -5431 43 -894 | 4216 -381 -1115 | -5143 399 -701 | -2159 106 -1378 | -1742 -626 * | -5074 210 * | 563 -466 | -1124 -720 | -4290 275 | -4871 394 | -3987 45 | -4561 96 | -4547 359 | -4016 117 | -2374 -369 | -1356 -294 | -292 -249 | 22600% |
| 116(A) | 3091 -149 -8 | -1829 -500 -8139 | -3998 233 -9181 | -4219 43 -894 | -4413 -381 -1115 | 119 399 -701 | -3637 106 -1378 | -4216 -626 * | -4134 210 * | -4469 -466 | -3523 -720 | -2798 275 | -2896 394 | -3656 45 | -3927 96 | 1514 359 | -1679 117 | -2983 -369 | -4632 -294 | -4539 -249 | 22700% |
| 117(H) | -5197 -149 -8 | -4539 -500 -8139 | -4720 233 -9181 | -5009 43 -894 | -4036 -381 -1115 | -4506 399 -701 | 5435 106 -1378 | -6314 -626 * | -4911 210 * | -5786 -466 | -5667 -720 | -4954 275 | -4960 394 | -5011 45 | -4732 96 | -5391 359 | -5395 117 | -6022 -369 | -4063 -294 | -3641 -249 | 22800% |
| 118(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 22900% |
| 119(F) | -4044 -149 -8 | -3387 -500 -8139 | -5534 233 -9181 | -5444 43 -894 | 4093 -381 -1115 | -5246 399 -701 | -2370 106 -1378 | -1514 -626 * | -5107 210 * | 1089 -466 | -868 -720 | -4443 275 | -4880 394 | -3998 45 | -4592 96 | -4639 359 | -3934 117 | -2200 -369 | -1536 -294 | -523 -249 | 23000% |
| 120(N) | 885 -149 -8 | -1899 -500 -8139 | -2020 233 -9181 | -1781 43 -894 | -2956 -381 -1115 | -2135 399 -701 | -1925 106 -1378 | -2602 -626 * | -1809 210 * | 3 -466 | -2052 -720 | 3468 275 | -2633 394 | -1676 45 | -2141 96 | 413 359 | -1437 117 | -2139 -369 | -3194 -294 | -2737 -249 | 23100% |
| 121(I) | -2673 -149 -8 | -2169 -500 -8139 | -5324 233 -9181 | -4969 43 -894 | -2477 -381 -1115 | -5123 399 -701 | -4876 106 -1378 | 3293 -626 * | -4893 210 * | 358 -466 | -1211 -720 | -4780 275 | -4824 394 | -4681 45 | -4961 96 | -4472 359 | -2653 117 | 1969 -369 | -4158 -294 | -3791 -249 | 23200% |
| 122(H) | -3381 -149 -8 | -3705 -500 -8139 | -3197 233 -9181 | -3491 43 -894 | -4166 -381 -1115 | 638 399 -701 | 5216 106 -1378 | -5496 -626 * | -3798 210 * | -5304 -466 | -4811 -720 | -3481 275 | -4185 394 | -3770 45 | -3879 96 | -3508 359 | -3702 117 | -4793 -369 | -4170 -294 | -3759 -249 | 23300% |
| 123(Y) | -4816 -149 -8 | -3757 -500 -8139 | -5210 233 -9181 | -5549 43 -894 | 3410 -381 -1115 | -5097 399 -701 | 2153 106 -1378 | -3719 -626 * | -5105 210 * | -3041 -466 | -3127 -720 | -3715 275 | -4955 394 | -3851 45 | -4483 96 | -4344 359 | -4669 117 | -3870 -369 | -547 -294 | 3677 -249 | 23400% |
| 124(G) | -1065 -149 -8 | -2519 -500 -8139 | 948 233 -9181 | -272 43 -894 | -2820 -381 -1115 | 1844 399 -701 | 998 106 -1378 | -2566 -626 * | 972 210 * | -284 -466 | -1622 -720 | 1553 275 | -2090 394 | -229 45 | -802 96 | -938 359 | -1011 117 | -2133 -369 | -2708 -294 | -2021 -249 | 23500% |
| 125(Q) | -412 -149 -8 | -2285 -500 -8139 | -2466 233 -9181 | -2186 43 -894 | -2068 -381 -1115 | -2877 399 -701 | -2019 106 -1378 | -1589 -626 * | -1588 210 * | 1526 -466 | -1121 -720 | -2187 275 | -3153 394 | 3585 45 | -1718 96 | -2137 359 | -1964 117 | -1719 -369 | -2789 -294 | -2414 -249 | 23600% |
| 126(I) | -2254 -149 -8 | -1916 -500 -8139 | -4813 233 -9181 | -4439 43 -894 | -2466 -381 -1115 | -4221 399 -701 | -3932 106 -1378 | 3248 -626 * | -4248 210 * | -1515 -466 | -1324 -720 | -4044 275 | -4259 394 | -4063 45 | -4255 96 | 230 359 | -2280 117 | 2003 -369 | -3673 -294 | -3237 -249 | 23700% |
| 127(K) | -888 -149 -8 | -2234 -500 -8139 | 334 233 -9181 | 1172 43 -894 | -2504 -381 -1115 | -1881 399 -701 | -546 106 -1378 | -93 -626 * | 1370 210 * | -300 -466 | -1337 -720 | 465 275 | -1974 394 | 655 45 | -646 96 | -794 359 | -827 117 | 1255 -369 | -2448 -294 | -1798 -249 | 23800% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 128(P) | 715 -149 -8 | -1925 -500 -8139 | -3618 233 -9181 | -3897 43 -894 | -4464 -381 -1115 | 653 399 -701 | -3594 106 -1378 | -4274 -626 * | -4053 210 * | -4520 -466 | -3596 -720 | -2770 275 | 3775 394 | -3593 45 | -3911 96 | -1550 359 | -1770 117 | -3067 -369 | -4647 -294 | -4548 -249 | 23900% |
| 129(P) | 479 -149 -8 | -2398 -500 -8139 | -1173 233 -9181 | -637 43 -894 | -2915 -381 -1115 | -2106 399 -701 | -848 106 -1378 | -2610 -626 * | -289 210 * | -2586 -466 | -1713 -720 | -884 275 | 2238 394 | 1247 45 | 2195 96 | 51 359 | -1147 117 | -2184 -369 | -2757 -294 | -2174 -249 | 24000% |
| 130(A) | 1787 -149 -2336 | -2663 -500 -8139 | 1377 233 -325 | 529 43 -894 | -2976 -381 -1115 | -1992 399 -701 | -762 106 -1378 | -2736 -626 * | 1785 210 * | -2680 -466 | -1776 -720 | -623 275 | -2161 394 | -319 45 | -936 96 | 297 359 | -1120 117 | -2285 -369 | -2853 -294 | -2146 -249 | 24100% |
| 131(F) | -1308 -149 -38 | -1104 -500 -5840 | -2227 233 -6882 | -2120 43 -894 | 3516 -381 -1115 | -2093 399 -701 | -244 106 -179 | -196 -626 * | -1891 210 * | 64 -466 | 66 -720 | -1626 275 | -2278 394 | -1503 45 | -1798 96 | -1617 359 | -1350 117 | -389 -369 | 305 -294 | 1335 -249 | 24200% |
| 132(P) | -603 -149 -38 | -937 -500 -5840 | -997 233 -6882 | -1058 43 -894 | -1832 -381 -1115 | -1041 399 -3098 | -1092 106 -179 | -1737 -626 * | -1074 210 * | -1874 -466 | -1416 -720 | -992 275 | 3539 394 | -1065 45 | -1192 96 | -789 359 | -866 117 | -1383 -369 | -1765 -294 | -1661 -249 | 24300% |
| 133(K) | -804 -149 -38 | -1483 -500 -5840 | -564 233 -6882 | -230 43 -894 | -1920 -381 -1115 | -1335 399 -3098 | -101 106 -179 | -1605 -626 * | 2889 210 * | -1630 -466 | -1021 -720 | -349 275 | -1569 394 | 232 45 | 698 96 | -786 359 | -759 117 | -1358 -369 | -1637 -294 | -1317 -249 | 24400% |
| 134(D) | -2405 -149 -38 | -4159 -500 -5840 | 3349 233 -6882 | -651 43 -894 | -4260 -381 -1115 | -261 399 -109 | -1744 106 -3775 | -4307 -626 * | -1947 210 * | -4207 -466 | -3514 -720 | 2151 275 | -2936 394 | -1416 45 | -2754 96 | -2102 359 | -2471 117 | -3802 -369 | -4324 -294 | 637 -249 | 24500% |
| 135(I) | -2047 -149 -8 | -1713 -500 -8139 | -4504 233 -9181 | -3983 43 -894 | -1821 -381 -1115 | -3943 399 -701 | -3061 106 -1378 | 2461 -626 * | -3697 210 * | 1581 -466 | -797 -720 | -3593 275 | -3873 394 | -3371 45 | -3587 96 | -342 359 | -2009 117 | 1904 -369 | -2784 -294 | -2441 -249 | 24600% |
| 136(D) | -2024 -149 -8 | -3444 -500 -8139 | 3495 233 -9181 | -680 43 -894 | -3868 -381 -1115 | -2331 399 -701 | -1596 106 -1378 | -44 -626 * | -1632 210 * | -3675 -466 | -2915 -720 | 685 275 | -2782 394 | -1248 45 | -2305 96 | 478 359 | -2088 117 | -3196 -369 | -3911 -294 | -3098 -249 | 24700% |
| 137(V) | -3122 -149 -8 | -2888 -500 -8139 | -5092 233 -9181 | -5160 43 -894 | -3522 -381 -1115 | -4180 399 -701 | -4687 106 -1378 | -905 -626 * | -5060 210 * | -2626 -466 | -2570 -720 | -4662 275 | -4579 394 | -4940 45 | -4923 96 | -4013 359 | -3297 117 | 3796 -369 | -4414 -294 | -4190 -249 | 24800% |
| 138(I) | -53 -149 -8 | -875 -500 -8139 | -3230 233 -9181 | -2609 43 -894 | 1867 -381 -1115 | -393 399 -701 | -1422 106 -1378 | 2613 -626 * | -2236 210 * | -723 -466 | -81 -720 | -2157 275 | -2608 394 | -1885 45 | -2086 96 | -1633 359 | 276 117 | -271 -369 | -1325 -294 | 844 -249 | 24900% |
| 139(M) | 315 -149 -8 | -2345 -500 -8139 | -4754 233 -9181 | -4279 43 -894 | -1396 -381 -1115 | -4001 399 -701 | -3301 106 -1378 | -697 -626 * | -3877 210 * | 816 -466 | 4676 -720 | -3879 275 | -3994 394 | -3361 45 | -3676 96 | -3242 359 | -2531 117 | -1114 -369 | -2746 -294 | -2629 -249 | 25000% |
| 140(V) | -2623 -149 -8 | -2122 -500 -8139 | -5301 233 -9181 | -4990 43 -894 | -2770 -381 -1115 | -5102 399 -701 | -5132 106 -1378 | 2415 -626 * | -4945 210 * | -1532 -466 | -1474 -720 | -4791 275 | -4869 394 | -4890 45 | -5102 96 | -4483 359 | -2619 117 | 3206 -369 | -4506 -294 | -3991 -249 | 25100% |
| 141(A) | 3405 -149 -8 | 2528 -500 -8139 | -4529 233 -9181 | -4796 43 -894 | -4340 -381 -1115 | -2257 399 -701 | -3851 106 -1378 | -3901 -626 * | -4447 210 * | -4351 -466 | -3532 -720 | -3057 275 | -3052 394 | -3976 45 | -4112 96 | -1643 359 | -1844 117 | -2929 -369 | -4572 -294 | -4519 -249 | 25200% |
| 142(P) | -4853 -149 -8 | -4392 -500 -8139 | -5213 233 -9181 | -5573 43 -894 | -5853 -381 -1115 | -4408 399 -701 | -5077 106 -1378 | -6679 -626 * | -5780 210 * | -6281 -466 | -6067 -720 | -5357 275 | 4310 394 | -5648 45 | -5396 96 | -5166 359 | -5194 117 | -6092 -369 | -4900 -294 | -5786 -249 | 25300% |
| 143(K) | -4484 -149 -8 | -4357 -500 -8139 | -4380 233 -9181 | -3992 43 -894 | -5413 -381 -1115 | -4236 399 -701 | -3307 106 -1378 | -5555 -626 * | 3994 210 * | -5171 -466 | -4707 -720 | -3921 275 | -4535 394 | -3079 45 | -2169 96 | -4529 359 | -4408 117 | -5264 -369 | -4403 -294 | -4729 -249 | 25400% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 144(G) | 2167 -149 -8 | -1833 -500 -8139 | -3963 233 -9181 | -4199 43 -894 | -4430 -381 -1115 | 2715 399 -701 | -3642 106 -1378 | -4236 -626 * | -4146 210 * | -4489 -466 | -3540 -720 | -2795 275 | -2898 394 | -3661 45 | -3939 96 | 910 359 | -1682 117 | -2994 -369 | -4647 -294 | -4556 -249 | 25500% |
| 145(P) | -2604 -149 -8 | -2948 -500 -8139 | -4094 233 -9181 | -4235 43 -894 | -3544 -381 -1115 | -3269 399 -701 | -3767 106 -1378 | -3353 -626 * | -3912 210 * | -3066 -466 | 2095 -720 | -3659 275 | 4036 394 | -3912 45 | -3822 96 | -2883 359 | -2963 117 | -3249 -369 | -4027 -294 | -3787 -249 | 25600% |
| 146(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 25700% |
| 147(H) | -2569 -149 -8 | -3440 -500 -8139 | -1867 233 -9181 | -1702 43 -894 | -3820 -381 -1115 | -2996 399 -701 | 4731 106 -1378 | -3830 -626 * | 634 210 * | -3639 -466 | -2963 -720 | -1838 275 | 1551 394 | -1305 45 | -748 96 | -2470 359 | -2510 117 | -3482 -369 | -3434 -294 | -2990 -249 | 25800% |
| 148(T) | 194 -149 -8 | -1498 -500 -8139 | -3255 233 -9181 | -2899 43 -894 | -2240 -381 -1115 | -2226 399 -701 | -2291 106 -1378 | -1754 -626 * | -2652 210 * | 1634 -466 | -1430 -720 | -2330 275 | -2747 394 | -2399 45 | -2684 96 | 567 359 | 2687 117 | -1484 -369 | -2682 -294 | -2351 -249 | 25900% |
| 149(V) | -3122 -149 -8 | -2888 -500 -8139 | -5092 233 -9181 | -5160 43 -894 | -3522 -381 -1115 | -4180 399 -701 | -4687 106 -1378 | -905 -626 * | -5060 210 * | -2626 -466 | -2570 -720 | -4662 275 | -4579 394 | -4940 45 | -4923 96 | -4013 359 | -3297 117 | 3796 -369 | -4414 -294 | -4190 -249 | 26000% |
| 150(R) | -4845 -149 -8 | -4446 -500 -8139 | -5107 233 -9181 | -4682 43 -894 | -5507 -381 -1115 | -4412 399 -701 | -3791 106 -1378 | -5946 -626 * | -2789 210 * | -5502 -466 | -5118 -720 | -4521 275 | -4754 394 | -3672 45 | 4219 96 | -4989 359 | -4832 117 | -5644 -369 | -4538 -294 | -4993 -249 | 26100% |
| 151(R) | -962 -149 -8 | -2395 -500 -8139 | -777 233 -9181 | 1012 43 -894 | -2721 -381 -1115 | 76 399 -701 | 1031 106 -1378 | -2459 -626 * | -142 210 * | -2413 -466 | -1501 -720 | -560 275 | -2018 394 | -128 45 | 2308 96 | 1224 359 | -66 117 | -2023 -369 | -2585 -294 | -1919 -249 | 26200% |
| 152(E) | -902 -149 -8 | -2032 -500 -8139 | -899 233 -9181 | 2078 43 -894 | -2228 -381 -1115 | -1934 399 -701 | -611 106 -1378 | -1897 -626 * | -259 210 * | -221 -466 | -1156 -720 | 520 275 | -2024 394 | 816 45 | -736 96 | -858 359 | 1303 117 | -287 -369 | -2295 -294 | 537 -249 | 26300% |
| 153(Y) | -4820 -149 -8 | -3765 -500 -8139 | -5219 233 -9181 | -5565 43 -894 | 3303 -381 -1115 | -5093 399 -701 | -1317 106 -1378 | -3703 -626 * | -5127 210 * | -3017 -466 | -3111 -720 | -3732 275 | -4959 394 | -3868 45 | -4500 96 | -4356 359 | -4679 117 | -3867 -369 | -565 -294 | 4052 -249 | 26400% |
| 154(V) | 129 -149 -8 | -1901 -500 -8139 | -989 233 -9181 | 821 43 -894 | -2060 -381 -1115 | -1969 399 -701 | -654 106 -1378 | -1704 -626 * | 498 210 * | -52 -466 | -1037 -720 | -703 275 | -2057 394 | 695 45 | -796 96 | 443 359 | -344 117 | 1871 -369 | -2192 -294 | -1626 -249 | 26500% |
| 155(Q) | 576 -149 -8 | -2355 -500 -8139 | 344 233 -9181 | 1156 43 -894 | -2675 -381 -1115 | -1856 399 -701 | -515 106 -1378 | -508 -626 * | 1502 210 * | -2370 -466 | -1444 -720 | 571 275 | -1949 394 | 1878 45 | 419 96 | -764 359 | -822 117 | -1976 -369 | -2538 -294 | -1856 -249 | 26600% |
| 156(G) | -3239 -149 -8 | -3889 -500 -8139 | 516 232 -9181 | -2361 44 -894 | -5355 -366 -1115 | 3646 399 -701 | -3337 105 -1378 | -5629 -627 * | -3818 211 * | -5498 -466 | -4951 -721 | -2619 277 | -3905 393 | -3187 45 | -4377 95 | -3211 359 | -3532 117 | -4837 -368 | -4895 -295 | -4826 -250 | 26700% |
| 157(G) | 753 -149 -8 | -3318 -500 -8139 | -789 233 -9181 | 488 43 -894 | -2848 -381 -1115 | 2300 399 -701 | -672 106 -1378 | 31 2582 -626 * | 596 210 * | -2529 -466 | -1627 -721 | 481 275 | -2112 394 | -224 45 | 471 95 | -962 359 | -1024 117 | -2149 -369 | -2694 -294 | -2033 -249 | 27300% |
| 158(G) | -52 -149 -8 | -2212 -500 -8139 | -3792 233 -9181 | -4133 43 -894 | -4698 -381 -1115 | 3627 399 -701 | -3843 106 -1378 | -4580 -626 * | -4356 210 * | -4812 -466 | -3937 -720 | -3058 275 | -3216 394 | -3901 45 | -4170 96 | -1874 359 | -2095 117 | -3384 -369 | -4734 -294 | -4766 -249 | 27400% |
| 159(V) | -2485 -155 -8 | -2030 -500 -8139 | -5123 233 -9181 | -4769 43 -894 | -2667 -381 -1115 | -4797 399 -701 | -4593 106 -1378 | 2349 -626 * | -4661 210 * | -1545 -466 | -1424 -720 | -4502 275 | -4648 394 | -4554 45 | -4752 96 | -4115 359 | 825 117 | 2986 -369 | -4159 -294 | -3678 -249 | 27500% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 160(P) | -2541 -149 -8 | -3139 -500 -8139 | -2413 233 -9181 | -2753 43 -894 | -4726 -381 -1115 | -2991 399 -701 | -3342 106 -1378 | -5055 -626 * | -3527 210 * | -5058 -466 | -4393 -720 | 1199 275 | 4031 394 | -3244 45 | -3757 96 | -2665 359 | -2911 117 | -4148 -369 | -4583 -294 | -4362 -249 | 27600% |
| 161(C) | 1577 -149 -8 | 3078 -500 -8139 | 1357 233 -9181 | -656 43 -894 | -2664 -381 -1115 | -219 399 -701 | 891 106 -1378 | -2359 -626 * | -617 210 * | -2434 -466 | -1576 -720 | -891 275 | -2199 394 | -545 45 | -1093 96 | 872 359 | -1043 117 | -1946 -369 | -2701 -294 | -2102 -249 | 27700% |
| 162(L) | -2140 -149 -8 | -2404 -500 -8139 | -3995 233 -9181 | -3997 43 -894 | -2053 -381 -1115 | -3121 399 -701 | -3283 106 -1378 | -1687 -626 * | -3689 210 * | 3041 -466 | -1200 -720 | -3360 275 | -3626 394 | -3433 45 | -3567 96 | 480 359 | -2414 117 | -1973 -369 | -3145 -294 | -2755 -249 | 27800% |
| 163(I) | -2527 -149 -8 | -2092 -500 -8139 | -5072 233 -9181 | -4613 43 -894 | 2047 -381 -1115 | -4674 399 -701 | -3911 106 -1378 | 2668 -626 * | -4413 210 * | 117 -466 | -841 -720 | -4323 275 | -4439 394 | -4023 45 | -4320 96 | -3916 359 | -2488 117 | 2176 -369 | -3342 -294 | -3040 -249 | 27900% |
| 164(A) | 3631 -149 -8 | -2768 -500 -8139 | -4492 233 -9181 | -4815 43 -894 | -4888 -381 -1115 | -2992 399 -701 | -4271 106 -1378 | -4781 -626 * | -4818 210 * | -5025 -466 | -4365 -720 | -3727 275 | -3728 394 | -4477 45 | -4545 96 | -2567 359 | -2762 117 | -3852 -369 | -4724 -294 | -4942 -249 | 28000% |
| 165(V) | -2623 -149 -8 | -2122 -500 -8139 | -5301 233 -9181 | -4990 43 -894 | -2770 -381 -1115 | -5102 399 -701 | -5132 106 -1378 | 2426 -626 * | -4946 210 * | -1532 -466 | -1474 -720 | -4791 275 | -4869 394 | -4891 45 | -5102 96 | -4483 359 | -2619 117 | 3200 -369 | -4506 -294 | -3991 -249 | 28100% |
| 166(H) | -495 -149 -8 | -2631 -500 -8139 | 903 233 -9181 | -2051 43 -894 | 722 -381 -1115 | -3242 399 -701 | 3753 106 -1378 | -2386 -626 * | -2056 210 * | -2342 -466 | -1863 -720 | -2047 275 | -3330 394 | -1815 45 | -2362 96 | -2318 359 | -2233 117 | -2272 -369 | -981 -294 | 3315 -249 | 28200% |
| 167(Q) | -4589 -149 -8 | -4392 -500 -8139 | -3927 233 -9181 | -4146 43 -894 | -5099 -381 -1115 | -4221 399 -701 | -4099 106 -1378 | -5973 -626 * | -3840 210 * | -5564 -466 | -5304 -720 | -4230 275 | -4693 394 | 4575 45 | -3826 96 | -4704 359 | -4772 117 | -5612 -369 | -4577 -294 | -4751 -249 | 28300% |
| 168(D) | -2873 -149 -8 | -4605 -500 -8139 | 3943 233 -9181 | -902 43 -894 | -4948 -381 -1115 | -2633 399 -701 | -2157 106 -1378 | -5087 -626 * | -2604 210 * | -4922 -466 | -4387 -720 | 428 275 | -3235 394 | -1872 45 | -3575 96 | -2522 359 | -3009 117 | -4491 -369 | -4932 -294 | -3946 -249 | 28400% |
| 169(A) | 1776 -149 -8 | -1612 -500 -8139 | -1274 233 -9181 | 138 43 -894 | -1698 -381 -1115 | -2092 399 -701 | -816 106 -1378 | -1295 -626 * | 150 210 * | -1526 -466 | -780 -720 | -943 275 | 1212 394 | -538 45 | -1013 96 | -1056 359 | -894 117 | 1275 -369 | -1968 -294 | 635 -249 | 28500% |
| 170(S) | -1545 -149 -8 | -2420 -500 -8139 | 1001 233 -9181 | -1518 43 -894 | -4049 -381 -1115 | -2206 399 -701 | -2206 106 -1378 | -3839 -626 * | -2264 210 * | -3938 -466 | -3103 -720 | -1627 275 | -2814 394 | -1909 45 | -2758 96 | 2666 359 | 2313 117 | -3045 -369 | -4143 -294 | -3560 -249 | 28600% |
| 171(G) | -2999 -149 -8 | -3461 -500 -8139 | -2978 233 -9181 | -3207 43 -894 | -5161 -381 -1115 | 3669 399 -701 | -3454 106 -1378 | -5283 -626 * | 15 210 * | -5188 -466 | -4565 -720 | -3174 275 | -3946 394 | -3312 45 | -3140 96 | -3128 359 | -3317 117 | -4492 -369 | -4622 -294 | -4749 -249 | 28700% |
| 172(N) | -887 -149 -8 | -2349 -500 -8139 | -736 233 -9181 | 911 43 -894 | -2668 -381 -1115 | -1860 399 -701 | -518 106 -1378 | -2415 -626 * | 711 210 * | -2363 -466 | -1440 -720 | 1880 275 | -1954 394 | 436 45 | 799 96 | 671 359 | 1230 117 | -539 -369 | -2534 -294 | -1855 -249 | 28800% |
| 173(A) | 3631 -149 -8 | -2768 -500 -8139 | -4492 233 -9181 | -4815 43 -894 | -4888 -381 -1115 | -2992 399 -701 | -4271 106 -1378 | -4781 -626 * | -4818 210 * | -5025 -466 | -4365 -720 | -3727 275 | -3728 394 | -4477 45 | -4545 96 | -2567 359 | -2762 117 | -3852 -369 | -4724 -294 | -4942 -249 | 28900% |
| 174(K) | -1368 -149 -8 | -2597 -500 -8139 | -1358 233 -9181 | -720 43 -894 | -2953 -381 -1115 | -2298 399 -701 | 1933 106 -1378 | -2603 -626 * | 1975 210 * | 851 -466 | -1706 -720 | -958 275 | -2360 394 | 859 45 | 1012 96 | -1273 359 | 1094 117 | -2245 -369 | -2690 -294 | -2165 -249 | 29000% |
| 175(D) | -27 -149 -8 | -2613 -500 -8139 | 2320 233 -9181 | 1049 43 -894 | -2923 -381 -1115 | -1962 399 -701 | 1973 106 -1378 | -2684 -626 * | 544 210 * | -2624 -466 | -1712 -720 | 1408 275 | -2115 394 | 345 45 | -869 96 | -969 359 | -1058 117 | -2231 -369 | -2793 -294 | -2087 -249 | 29100% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 176(V) | -1096 -149 -8 | -938 -500 -8139 | -3279 233 -9181 | -2658 43 -894 | -899 -381 -1115 | -2643 399 -701 | -1513 106 -1378 | 1265 -626 * | 1006 210 * | 1388 -466 | -124 -720 | -2232 275 | -2688 394 | -1950 45 | -2151 96 | -1725 359 | -311 117 | 1669 -369 | -1425 -294 | 827 -249 | 29200% |
| 177(A) | 3342 -149 -8 | -1826 -500 -8139 | -4064 233 -9181 | -4295 43 -894 | -4368 -381 -1115 | 111 399 -701 | -3651 106 -1378 | -4129 -626 * | -4159 210 * | -4412 -466 | -3484 -720 | -2820 275 | -2903 394 | -3689 45 | -3929 96 | -1469 359 | 409 117 | -2949 -369 | -4599 -294 | -4508 -249 | 29300% |
| 178(L) | -4414 -149 -8 | -3800 -500 -8139 | -5638 233 -9181 | -5628 43 -894 | -2290 -381 -1115 | -4980 399 -701 | -4628 106 -1378 | -1886 -626 * | -5423 210 * | 3316 -466 | -1236 -720 | -5514 275 | -4997 394 | -4750 45 | -5002 96 | -5379 359 | -4399 117 | -2629 -369 | -3665 -294 | -3690 -249 | 29400% |
| 179(S) | 2216 -149 -8 | -1831 -500 -8139 | -3961 233 -9181 | -4157 43 -894 | -4409 -381 -1115 | 656 399 -701 | -3608 106 -1378 | -4213 -626 * | -4076 210 * | -4462 -466 | -3514 -720 | -2782 275 | -2892 394 | -3613 45 | -3895 96 | 2686 359 | -1675 117 | -2982 -369 | -4623 -294 | -4523 -249 | 29500% |
| 180(Y) | -3634 -149 -8 | -3050 -500 -8139 | -4918 233 -9181 | -4872 43 -894 | 36 -381 -1115 | -4597 399 -701 | -1405 106 -1378 | 223 -626 * | -4437 210 * | -250 -466 | -1998 -720 | -3545 275 | -4494 394 | -3522 45 | -4004 96 | -3782 359 | -3536 117 | -2621 -369 | -2928 -294 | 4349 -249 | 29600% |
| 181(A) | 3391 -149 -8 | -1860 -500 -8139 | -3998 233 -9181 | -4279 43 -894 | -4411 -381 -1115 | -2128 399 -701 | -3684 106 -1378 | -4207 -626 * | -4197 210 * | -4490 -466 | -3565 -720 | -2837 275 | -2929 394 | -3729 45 | -3959 96 | 706 359 | -1718 117 | -3001 -369 | -4636 -294 | -4534 -249 | 29700% |
| 182(K) | 370 -149 -8 | 307 -500 -8139 | 113 233 -9181 | -351 43 -894 | -2280 -381 -1115 | -1925 399 -701 | -615 106 -1378 | 324 -626 * | 1888 210 * | -2040 -466 | -1194 -720 | -632 275 | -2022 394 | -205 45 | -736 96 | 1541 359 | 14 117 | -1628 -369 | -2330 -294 | -1726 -249 | 29800% |
| 183(G) | 2572 -149 -8 | -2028 -500 -8139 | -3934 233 -9181 | -4246 43 -894 | -4575 -381 -1115 | 2752 399 -701 | -3783 106 -1378 | -4406 -626 * | -4316 210 * | -4661 -466 | -3751 -720 | -2958 275 | -3070 394 | -3837 45 | -4092 96 | -1679 359 | -1898 117 | -3191 -369 | -4701 -294 | -4686 -249 | 29900% |
| 184(I) | -2178 -149 -8 | -1808 -500 -8139 | -4630 233 -9181 | -4153 43 -894 | -2094 -381 -1115 | -4190 399 -701 | -3417 106 -1378 | 3121 -626 * | -3909 210 * | 311 -466 | -1023 -720 | 698 275 | -4099 394 | -3656 45 | -3864 96 | -3388 359 | -2148 117 | 1742 -369 | -3147 -294 | -2761 -249 | 30000% |
| 185(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 30100% |
| 186(G) | 1392 -149 -8 | -2751 -500 -8139 | -4353 233 -9181 | -4536 43 -894 | -4308 -381 -1115 | 2864 399 -701 | -3681 106 -1378 | -4084 -626 * | -4233 210 * | -4354 -466 | -3425 -720 | -2859 275 | -2890 394 | -3744 45 | -3957 96 | 712 359 | -1656 117 | -2914 -369 | -4553 -294 | -4470 -249 | 30200% |
| 187(G) | 855 -149 -8 | -1822 -500 -8139 | -3738 233 -9181 | -3769 43 -894 | -4188 -381 -1115 | 2507 399 -701 | -3358 106 -1378 | -3950 -626 * | -3667 210 * | -4196 -466 | -3283 -720 | -2667 275 | 986 394 | -3302 45 | -3621 96 | -1441 359 | 2334 117 | -2867 -369 | -4408 -294 | -4236 -249 | 30300% |
| 188(R) | -3706 -149 -155 | -3692 -500 -8139 | -4490 233 -9181 | -3846 43 -894 | 1391 -381 -1115 | -4057 399 -701 | -2273 106 -1378 | -3795 -626 * | -1906 210 * | -3355 -466 | -3181 -720 | -3458 275 | -4263 394 | -2675 45 | 3948 96 | -3768 359 | -3671 117 | -3813 -369 | -2293 -294 | -1328 -249 | 30400% |
| 189(A) | 2844 -149 -8 | -1670 -500 -8139 | -3814 233 -3345 | -3873 43 -894 | -4048 -381 -1115 | -1958 399 -701 | -3316 106 -1378 | -3787 -626 * | -3686 210 * | -4061 -466 | -3156 -720 | -2598 275 | -2734 394 | -3301 45 | -3572 96 | 1088 359 | 1907 117 | -2713 -369 | -4286 -294 | -4136 -249 | 30500% |
| 190(G) | -4176 -149 -8 | -3995 -500 -7992 | -4855 233 -9034 | -5222 43 -894 | -5686 -381 -1115 | 3828 399 -422 | -4823 106 -1980 | -6386 -626 * | -5533 210 * | -6087 -466 | -5741 -720 | -4896 275 | -4606 394 | -5312 45 | -5178 96 | -4461 359 | -4560 117 | -5613 -369 | -4754 -294 | -5635 -249 | 30600% |
| 191(V) | -2496 -149 -8 | -2036 -500 -8139 | -5139 233 -9181 | -4788 43 -894 | -2680 -381 -1115 | -4825 399 -701 | -4637 106 -1378 | 2522 -626 * | -4686 210 * | -1549 -466 | -1431 -720 | -4527 275 | -4668 394 | -4584 45 | -4783 96 | -4148 359 | 629 117 | 2919 -369 | -4191 -294 | -3706 -249 | 30700% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 192(I) | -2760 -149 -8 | -2307 -500 -8139 | -5270 233 -9181 | -4785 43 -894 | 1172 -381 -1115 | -4884 399 -701 | -3992 106 -1378 | 3346 -626 * | -4576 210 * | 662 -466 | -572 -720 | -4539 275 | -4535 394 | -4008 45 | -4400 96 | -4134 359 | -2703 117 | 757 -369 | -3223 -294 | -3041 -249 | 30800% |
| 193(E) | 454 -149 -8 | -3086 -500 -8139 | -801 233 -9181 | 3279 43 -894 | -4125 -381 -1115 | -2346 399 -701 | -1868 106 -1378 | -3919 -626 * | -1868 210 * | -3932 -466 | -3156 -720 | -1291 275 | 1208 394 | -1533 45 | -2450 96 | -1842 359 | -2097 117 | -3305 -369 | -4121 -294 | -3395 -249 | 30900% |
| 194(T) | -2738 -149 -8 | -3109 -500 -8139 | -4509 233 -9181 | -4810 43 -894 | -4918 -381 -1115 | -3305 399 -701 | -4346 106 -1378 | -4865 -626 * | -4769 210 * | -5072 -466 | -4551 -720 | -3987 275 | -3998 394 | -4580 45 | -4545 96 | -2999 359 | 4033 117 | -4113 -369 | -4684 -294 | -4915 -249 | 31000% |
| 195(T) | -1323 -149 -8 | -1975 -500 -8139 | -2766 233 -9181 | -2978 43 -894 | -4207 -381 -1115 | -2152 399 -701 | -3105 106 -1378 | -4004 -626 * | -3295 210 * | -4229 -466 | -3354 -720 | 134 275 | -2901 394 | -2988 45 | -3387 96 | -113 359 | 3742 117 | -2969 -369 | -4405 -294 | -4119 -249 | 31100% |
| 196(F) | -4110 -149 -8 | -3437 -500 -8139 | -5436 233 -9181 | -5431 43 -894 | 4216 -381 -1115 | -5143 399 -701 | -2159 106 -1378 | -1742 -626 * | -5074 210 * | 563 -466 | -1124 -720 | -4290 275 | -4871 394 | -3987 45 | -4561 96 | -4547 359 | -4016 117 | -2374 -369 | -1356 -294 | -292 -249 | 31200% |
| 197(K) | -111 -149 -8 | -2844 -500 -8139 | -1470 233 -9181 | 1220 43 -894 | -3294 -381 -1115 | -2415 399 -701 | -860 106 -1378 | -2939 -626 * | 2448 210 * | -2798 -466 | -1945 -720 | -1056 275 | -2475 394 | 767 45 | 2054 96 | -1421 359 | -1432 117 | -2544 -369 | -2858 -294 | -2356 -249 | 31300% |
| 198(E) | 545 -149 -8 | -3735 -500 -8139 | 1715 233 -9181 | 2880 43 -894 | -3981 -381 -1115 | -2308 399 -701 | -1442 106 -1378 | -3818 -626 * | -1408 210 * | -3725 -466 | -2924 -720 | -909 275 | -2713 394 | 1281 45 | -2087 96 | -1777 359 | -2041 117 | -3331 -369 | -3909 -294 | -3046 -249 | 31400% |
| 199(E) | -4574 -149 -8 | -4665 -500 -8139 | -2714 233 -9181 | 3919 43 -894 | -5655 -381 -1115 | -3995 399 -701 | -3886 106 -1378 | -6219 -626 * | -4238 210 * | -5898 -466 | -5604 -720 | -3415 275 | -4513 394 | -3838 45 | -4570 96 | -4456 359 | -4726 117 | -5786 -369 | -4878 -294 | -5197 -249 | 31500% |
| 200(T) | -1211 -149 -8 | 1331 -500 -8139 | -3446 233 -9181 | -2962 43 -894 | -1399 -381 -1115 | -2495 399 -701 | -1930 106 -1378 | -869 -626 * | -2610 210 * | -1374 -466 | -769 -720 | -2403 275 | -2815 394 | -2309 45 | -2526 96 | -1685 359 | 3305 117 | 195 -369 | -1933 -294 | 1430 -249 | 31600% |
| 201(E) | -1941 -149 -8 | -3222 -500 -8139 | -921 233 -9181 | 3293 43 -894 | -3618 -381 -1115 | -2473 399 -701 | -1316 106 -1378 | -3186 -626 * | 916 210 * | -3225 -466 | -2465 -720 | -1147 275 | -2749 394 | -923 45 | -1064 96 | -1790 359 | -1902 117 | -171 -369 | -3398 -294 | -2802 -249 | 31700% |
| 202(T) | -1286 -149 -8 | -1898 -500 -8139 | -3764 233 -9181 | -4016 43 -894 | -4329 -381 -1115 | -2157 399 -701 | -3572 106 -1378 | -4120 -626 * | -3959 210 * | -4408 -466 | -3517 -720 | -2789 275 | -2947 394 | -3588 45 | -3797 96 | 697 359 | 3756 117 | -2989 -369 | -4554 -294 | -4399 -249 | 31800% |
| 203(D) | -4580 -149 -8 | -4701 -500 -8139 | 4174 233 -9181 | -3014 43 -894 | -5700 -381 -1115 | -3967 399 -701 | -3905 106 -1378 | -6376 -626 * | -4478 210 * | -6024 -466 | -5744 -720 | -3355 275 | -4501 394 | -3870 45 | -4926 96 | -4440 359 | -4750 117 | -5894 -369 | -4922 -294 | -5231 -249 | 31900% |
| 204(L) | -3705 -149 -8 | -3122 -500 -8139 | -6060 233 -9181 | -5527 43 -894 | -1359 -381 -1115 | -5814 399 -701 | -4569 106 -1378 | 1065 -626 * | -5292 210 * | 3069 -466 | -146 -720 | -5564 275 | -4963 394 | -4163 45 | -4828 96 | -5215 359 | -3571 117 | -1279 -369 | -3159 -294 | -3298 -249 | 32000% |
| 205(F) | -3777 -149 -8 | -3220 -500 -8139 | -5271 233 -9181 | -5259 43 -894 | 4268 -381 -1115 | -4892 399 -701 | -2120 106 -1378 | 417 -626 * | -4916 210 * | -1143 -466 | -1314 -720 | -4142 275 | -4753 394 | -3956 45 | -4473 96 | -4270 359 | -3740 117 | -1899 -369 | -1349 -294 | -269 -249 | 32100% |
| 206(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 32200% |
| 207(E) | -4574 -149 -8 | -4665 -500 -8139 | -2714 233 -9181 | 3919 43 -894 | -5655 -381 -1115 | -3995 399 -701 | -3886 106 -1378 | -6219 -626 * | -4238 210 * | -5898 -466 | -5604 -720 | -3415 275 | -4513 394 | -3838 45 | -4570 96 | -4456 359 | -4726 117 | -5786 -369 | -4878 -294 | -5197 -249 | 32300% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 208(Q) | -3157 -149 -8 | -3746 -500 -8139 | -3170 233 -9181 | -2450 43 -894 | -4497 -381 -1115 | -3515 399 -701 | -1763 106 -1378 | -4161 -626 * | -443 210 * | -3809 -466 | -3189 -720 | -2392 275 | -3620 394 | 4200 45 | 1284 96 | -3063 359 | -2944 117 | -3900 -369 | -3556 -294 | -3420 -249 | 32400% |
| 209(A) | 2672 -149 -8 | -1334 -500 -8139 | -3318 233 -9181 | -2853 43 -894 | -1740 -381 -1115 | 371 399 -701 | -2072 106 -1378 | 483 -626 * | -2577 210 * | -1549 -466 | -928 -720 | -2359 275 | -2798 394 | -2295 45 | -2567 96 | -1629 359 | 191 117 | 932 -369 | -2245 -294 | -1899 -249 | 32500% |
| 210(V) | -2620 -149 -8 | -2125 -500 -8139 | -5293 233 -9181 | -4983 43 -894 | -2756 -381 -1115 | -5076 399 -701 | -5100 106 -1378 | 1877 -626 * | -4932 210 * | -1522 -466 | -1466 -720 | -4777 275 | -4855 394 | -4870 45 | -5082 96 | -4456 359 | -2619 117 | 3416 -369 | -4480 -294 | -3969 -249 | 32600% |
| 211(L) | -4414 -149 -8 | -3800 -500 -8139 | -5638 233 -9181 | -5628 43 -894 | -2290 -381 -1115 | -4980 399 -701 | -4628 106 -1378 | -1886 -626 * | -5423 210 * | 3316 -466 | -1236 -720 | -5514 275 | -4997 394 | -4750 45 | -5002 96 | -5379 359 | -4399 117 | -2629 -369 | -3665 -294 | -3690 -249 | 32700% |
| 212(C) | -2243 -149 -8 | 5044 -500 -8139 | -4840 233 -9181 | -4445 43 -894 | -1998 -381 -1115 | -3905 399 -701 | -3598 106 -1378 | -31 -626 * | -4138 210 * | 449 -466 | -930 -720 | -3902 275 | -4040 394 | -3778 45 | -4010 96 | -3184 359 | -2306 117 | 1347 -369 | -3209 -294 | -2883 -249 | 32800% |
| 213(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 32900% |
| 214(G) | 677 -149 -8 | -2128 -500 -8139 | -3838 233 -9181 | -4171 43 -894 | -4647 -381 -1115 | -3536 399 -701 | -3816 106 -1378 | -4506 -626 * | -4340 210 * | -4749 -466 | -3857 -720 | -3009 275 | -3149 394 | -3871 45 | -4137 96 | -1784 359 | -2005 117 | -3297 -369 | -4725 -294 | -4735 -249 | 33000% |
| 215(V) | 378 -149 -8 | 724 -500 -8139 | -3707 233 -9181 | -3104 43 -894 | -1180 -381 -1115 | -2986 399 -701 | -1919 106 -1378 | 1210 -626 * | -2734 210 * | 1302 -466 | -359 -720 | -2627 275 | -3014 394 | -2382 45 | -2566 96 | -2089 359 | 1123 117 | 1949 -369 | -1773 -294 | -1423 -249 | 33100% |
| 216(M) | -948 -149 -8 | -1407 -500 -8139 | -1515 233 -9181 | 156 43 -894 | -1452 -381 -1115 | -2164 399 -701 | 1677 106 -1378 | -1030 -626 * | -821 210 * | -1302 -466 | 1976 -720 | -1113 275 | -2245 394 | -718 45 | -1173 96 | 773 359 | 1715 117 | 1332 -369 | -1794 -294 | -1343 -249 | 33200% |
| 217(E) | 1397 -149 -8 | -2528 -500 -8139 | -725 233 -9181 | 2286 43 -894 | -2932 -381 -1115 | 240 399 -701 | -791 106 -1378 | -2681 -626 * | 328 210 * | -2645 -466 | -1744 -720 | -674 275 | -2162 394 | -351 45 | -939 96 | 545 359 | -1095 117 | -2227 -369 | -2828 -294 | -2143 -249 | 33300% |
| 218(L) | -3705 -149 -8 | -3122 -500 -8139 | -6060 233 -9181 | -5527 43 -894 | -1359 -381 -1115 | -5814 399 -701 | -4569 106 -1378 | 1065 -626 * | -5292 210 * | 3069 -466 | -146 -720 | -5564 275 | -4963 394 | -4163 45 | -4828 96 | -5215 359 | -3571 117 | -1279 -369 | -3159 -294 | -3298 -249 | 33400% |
| 219(V) | -2600 -149 -8 | -2108 -500 -8139 | -5251 233 -9181 | -4894 43 -894 | -2568 -381 -1115 | -5025 399 -701 | -4783 106 -1378 | 2479 -626 * | -4810 210 * | -1354 -466 | 1358 -720 | -4683 275 | -4772 394 | -4654 45 | -4895 96 | -4362 359 | -2584 117 | 3018 -369 | -4181 -294 | -3758 -249 | 33500% |
| 220(K) | -1633 -149 -8 | -2905 -500 -8139 | -1573 233 -9181 | 706 43 -894 | -3375 -381 -1115 | -2487 399 -701 | -900 106 -1378 | -3003 -626 * | 2925 210 * | -2849 -466 | -2008 -720 | -1128 275 | -2541 394 | 1714 45 | 784 96 | -1509 359 | -105 117 | -2617 -369 | -2894 -294 | -2418 -249 | 33600% |
| 221(A) | 2352 -149 -8 | 2066 -500 -8139 | -2593 233 -9181 | -2000 43 -894 | -947 -381 -1115 | -2434 399 -701 | -1271 106 -1378 | -486 -626 * | -32 210 * | -832 -466 | 714 -720 | -1817 275 | -2498 394 | -1493 45 | -1792 96 | -1483 359 | 274 117 | 453 -369 | -1419 -294 | 501 -249 | 33700% |
| 222(G) | 224 -149 -8 | -1905 -500 -8139 | -3562 233 -9181 | -3696 43 -894 | -3684 -381 -1115 | 3361 399 -701 | -3297 106 -1378 | -3220 -626 * | -3625 210 * | 81 -466 | -2886 -720 | -2733 275 | -2977 394 | -3326 45 | -3545 96 | -1606 359 | -1763 117 | -2574 -369 | -4068 -294 | -3810 -249 | 33800% |
| 223(F) | -4781 -149 -8 | -3756 -500 -8139 | -5207 233 -9181 | -5542 43 -894 | 4341 -381 -1115 | -5070 399 -701 | -1342 106 -1378 | -3653 -626 * | -5111 210 * | -2971 -466 | -3065 -720 | -3743 275 | -4949 394 | -3874 45 | -4496 96 | -4351 359 | -4650 117 | -3829 -369 | -591 -294 | 1725 -249 | 33900% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 224(E) | -2413 -149 -8 | -4114 -500 -8139 | 221 233 -9181 | 3465 43 -894 | -4392 -381 -1115 | -2485 399 -701 | -1689 106 -1378 | -4248 -626 * | -1608 210 * | -4112 -466 | -3396 -720 | -1094 275 | -2951 394 | -1336 45 | 871 96 | -2119 359 | -2441 117 | -3763 -369 | -4239 -294 | -3395 -249 | 34000% |
| 225(T) | -1461 -149 -8 | -1864 -500 -8139 | -3139 233 -9181 | -2645 43 -894 | -2659 -381 -1115 | -2483 399 -701 | -2136 106 -1378 | -1734 -626 * | -1646 210 * | -2359 -466 | -1761 -720 | -2298 275 | -2936 394 | -1995 45 | 920 96 | -1748 359 | 3354 117 | 967 -369 | -2989 -294 | -2654 -249 | 34100% |
| 226(L) | -3831 -149 -8 | -3266 -500 -8139 | -5314 233 -9181 | -5148 43 -894 | -673 -381 -1115 | -5068 399 -701 | -2476 106 -1378 | -1443 -626 * | -4706 210 * | 3059 -466 | -789 -720 | -4359 275 | -4756 394 | -3864 45 | -4314 96 | -4462 359 | -3729 117 | -2115 -369 | -1672 -294 | 1736 -249 | 34200% |
| 227(V) | -1819 -149 -8 | -1960 -500 -8139 | -4426 233 -9181 | -4359 43 -894 | -2977 -381 -1115 | -3037 399 -701 | -3800 106 -1378 | -439 -626 * | -4098 210 * | -2145 -466 | -1909 -720 | -3451 275 | -3600 394 | -3879 45 | -4011 96 | -2397 359 | 2510 117 | 2999 -369 | -3974 -294 | -3608 -249 | 34300% |
| 228(E) | -2863 -149 -8 | -4790 -500 -8139 | 1397 233 -9181 | 3563 43 -894 | -4990 -381 -1115 | -2594 399 -701 | -2061 106 -1378 | -5021 -626 * | -2476 210 * | -4848 -466 | -4298 -720 | -1204 275 | -3182 394 | -1761 45 | -3454 96 | -2476 359 | -2968 117 | -4462 -369 | -4951 -294 | -3920 -249 | 34400% |
| 229(A) | 2686 -149 -8 | -1916 -500 -8139 | -1440 233 -9181 | 275 43 -894 | -2529 -381 -1115 | -292 399 -701 | -1240 106 -1378 | -2176 -626 * | -998 210 * | -2345 -466 | 1183 -720 | -1184 275 | -2355 394 | -905 45 | -1425 96 | 512 359 | -1158 117 | -1817 -369 | -2697 -294 | -2174 -249 | 34500% |
| 230(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 34600% |
| 231(Y) | -4099 -149 -8 | -3483 -500 -8139 | -4921 233 -9181 | -5048 43 -894 | -109 -381 -1115 | -4705 399 -701 | -1565 106 -1378 | -2914 -626 * | -4494 210 * | -2334 -466 | 2010 -720 | -3723 275 | -4707 394 | -3735 45 | -4111 96 | -4065 359 | -4068 117 | -3172 -369 | -847 -294 | 4618 -249 | 34700% |
| 232(Q) | 1711 -149 -8 | -2410 -500 -8139 | -772 233 -9181 | 934 43 -894 | -2739 -381 -1115 | -1925 399 -701 | -604 106 -1378 | -2477 -626 * | -171 210 * | -2433 -466 | -1524 -720 | -574 275 | -2035 394 | 2086 45 | 345 96 | 902 359 | -923 117 | -2042 -369 | -2608 -294 | -1941 -249 | 34800% |
| 233(P) | -3403 -149 -8 | -4071 -500 -8139 | -1922 233 -9181 | 817 43 -894 | -5220 -381 -1115 | -3359 399 -701 | -3173 106 -1378 | -5423 -626 * | -3337 210 * | -5281 -466 | -4771 -720 | -2564 275 | 4045 394 | -2989 45 | -3760 96 | -3320 359 | -3624 117 | -4817 -369 | -4763 -294 | -4636 -249 | 34900% |
| 234(E) | -2870 -149 -8 | -4786 -500 -8139 | 1265 233 -9181 | 3587 43 -894 | -4993 -381 -1115 | -2600 399 -701 | -2068 106 -1378 | -5026 -626 * | -2483 210 * | -4852 -466 | -4303 -720 | -1212 275 | -3188 394 | -1768 45 | -3458 96 | -2484 359 | -2974 117 | -4467 -369 | -4950 -294 | -3925 -249 | 35000% |
| 235(M) | -3089 -149 -8 | -2618 -500 -8139 | -5526 233 -9181 | -4976 43 -894 | -1443 -381 -1115 | -5128 399 -701 | -4045 106 -1378 | 653 -626 * | -4735 210 * | 1429 -466 | 4269 -720 | -4803 275 | -4610 394 | -3915 45 | -4423 96 | -4378 359 | -2995 117 | 1140 -369 | -3054 -294 | -3074 -249 | 35100% |
| 236(A) | 3631 -149 -8 | -2768 -500 -8139 | -4492 233 -9181 | -4815 43 -894 | -4888 -381 -1115 | -2992 399 -701 | -4271 106 -1378 | -4781 -626 * | -4818 210 * | -5025 -466 | -4365 -720 | -3727 275 | -3728 394 | -4477 45 | -4545 96 | -2567 359 | -2762 117 | -3852 -369 | -4724 -294 | -4942 -249 | 35200% |
| 237(Y) | -4797 -149 -8 | -3764 -500 -8139 | -5203 233 -9181 | -5543 43 -894 | 1114 -381 -1115 | -5069 399 -701 | -1339 106 -1378 | -3694 -626 * | -5111 210 * | -3013 -466 | -3107 -720 | -3741 275 | -4951 394 | -3876 45 | -4497 96 | -4354 359 | -4666 117 | -3859 -369 | -588 -294 | 4723 -249 | 35300% |
| 238(F) | -3828 -149 -8 | -3605 -500 -8139 | -4146 233 -9181 | -4086 43 -894 | 4292 -381 -1115 | -4207 399 -701 | -2060 106 -1378 | -3492 -626 * | 774 210 * | -3071 -466 | -3005 -720 | -3556 275 | -4434 394 | -3287 45 | -2952 96 | -3868 359 | -3858 117 | -3571 -369 | -1593 -294 | -494 -249 | 35400% |
| 239(E) | -2775 -149 -8 | -4471 -500 -8139 | -511 233 -9181 | 3582 43 -894 | -4815 -381 -1115 | -2610 399 -701 | -2057 106 -1378 | -4863 -626 * | -2317 210 * | -4711 -466 | -4124 -720 | 1234 275 | -3182 394 | -1755 45 | -3103 96 | -2442 359 | -2884 117 | -4306 -369 | -4753 -294 | -3820 -249 | 35500% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 240(C) | -1407 -149 -8 | 5023 -500 -8139 | -4397 233 -9181 | -4323 43 -894 | -3016 -381 -1115 | -2468 399 -701 | -3398 106 -1378 | -1251 -626 * | -3952 210 * | -2540 -466 | -2082 -720 | -3044 275 | -3133 394 | -3588 45 | -3744 96 | -1803 359 | 1473 117 | 1125 -369 | -3677 -294 | -3390 -249 | 35600% |
| 241(L) | -3370 -149 -8 | -2847 -500 -8139 | -5795 233 -9181 | -5233 43 -894 | -1386 -381 -1115 | -5465 399 -701 | -4298 106 -1378 | 708 -626 * | -5010 210 * | 2859 -466 | 1349 -720 | -5155 275 | -4777 394 | -4026 45 | -4622 96 | -4755 359 | -3254 117 | 814 -369 | -3103 -294 | -3213 -249 | 35700% |
| 242(H) | -2519 -149 -8 | -4224 -500 -8139 | -445 233 -9181 | 946 43 -894 | -4287 -381 -1115 | -2505 399 -701 | 4583 106 -1378 | -4377 -626 * | -1764 210 * | -4237 -466 | -3571 -720 | 2007 275 | -3009 394 | -1439 45 | -2361 96 | -2209 359 | -2569 117 | -3893 -369 | -4267 -294 | -3353 -249 | 35800% |
| 243(E) | -3177 -149 -8 | 2571 -500 -8139 | -2701 233 -9181 | 3711 43 -894 | -4851 -381 -1115 | -3438 399 -701 | -3479 106 -1378 | -4765 -626 * | -3558 210 * | -4932 -466 | -4406 -720 | -3081 275 | -4005 394 | -3370 45 | -3802 96 | -3269 359 | -3451 117 | -4260 -369 | -4554 -294 | -4524 -249 | 35900% |
| 244(L) | -85 -149 -8 | -1333 -500 -8139 | -3893 233 -9181 | -3280 43 -894 | -1111 -381 -1115 | -3185 399 -701 | -2083 106 -1378 | 1066 -626 * | -2910 210 * | 2310 -466 | 1961 -720 | -2823 275 | -3170 394 | -2501 45 | -2721 96 | -2289 359 | -113 117 | 436 -369 | -1859 -294 | -1558 -249 | 36000% |
| 245(K) | -2513 -149 -155 | -3173 -500 -8139 | -2941 233 -9181 | -2370 43 -196 | -4402 -381 -2974 | -3094 400 -701 | -1824 106 -1378 | -3895 -626 * | 3666 210 * | -3734 -466 | -3068 -720 | -2271 275 | -3377 394 | -1447 45 | -616 96 | -2537 359 | 751 117 | -3485 -369 | -3625 -294 | -3471 -249 | 36100% |
| 246(L) | -3571 -149 -8 | -3023 -500 -8139 | -5954 233 -9181 | -5375 43 -894 | -1321 -381 -1115 | -5646 399 -701 | -4390 106 -1378 | -632 -626 * | -5138 210 * | 2962 -466 | 1671 -720 | -5358 275 | -4852 394 | -4044 45 | -4689 96 | -4963 359 | -3436 117 | 742 -369 | -3082 -294 | -3239 -249 | 36300% |
| 247(I) | -2980 -149 -8 | -2484 -500 -8139 | -5473 233 -9181 | -5109 43 -894 | -1958 -381 -1115 | -5196 399 -701 | -4587 106 -1378 | 3728 -626 * | -4915 210 * | 267 -466 | -781 -720 | -4933 275 | -4833 394 | -4427 45 | -4799 96 | -4598 359 | -2949 117 | -64 -369 | -3627 -294 | -3397 -249 | 36400% |
| 248(V) | -1685 -149 -8 | -1668 -500 -8139 | -4095 233 -9181 | -3732 43 -894 | -2081 -381 -1115 | -3082 399 -701 | -2893 106 -1378 | -227 -626 * | -3402 210 * | -1488 -466 | 1383 -720 | -3123 275 | -3419 394 | -3145 45 | -3320 96 | 367 359 | -1807 117 | 3332 -369 | -2874 -294 | -2504 -249 | 36500% |
| 249(D) | -2963 -149 -8 | -4569 -500 -8139 | 3864 233 -9181 | -1039 43 -894 | -4953 -381 -1115 | -2751 399 -701 | -2187 106 -1378 | -4998 -626 * | 767 210 * | -4822 -466 | -4260 -720 | -1424 275 | -3314 394 | -1891 45 | -3072 96 | -2624 359 | -3060 117 | -4467 -369 | -4770 -294 | -3962 -249 | 36600% |
| 250(L) | -2768 -149 -8 | -2715 -500 -8139 | -4842 233 -9181 | -4633 43 -894 | -1675 -381 -1115 | -3998 399 -701 | -3790 106 -1378 | -1038 -626 * | -4207 210 * | 3056 -466 | -562 -720 | -4150 275 | -4179 394 | -3740 45 | -3989 96 | -3399 359 | 699 117 | -1545 -369 | -3154 -294 | -3067 -249 | 36700% |
| 251(M) | -2822 -149 -8 | -2356 -500 -8139 | -5342 233 -9181 | -4861 43 -894 | -1759 -381 -1115 | -4985 399 -701 | -4151 106 -1378 | 2587 -626 * | -4663 210 * | 173 -466 | 4005 -720 | -4649 275 | -4601 394 | -4076 45 | -4487 96 | -4251 359 | -2764 117 | 766 -369 | -3321 -294 | -3210 -249 | 36800% |
| 252(Y) | -4562 -149 -8 | -3630 -500 -8139 | -5142 233 -9181 | -5401 43 -894 | 1516 -381 -1115 | -4992 399 -701 | -1300 106 -1378 | -3544 -626 * | -4968 210 * | -2963 -466 | -2986 -720 | -3671 275 | -4868 394 | -3786 45 | -4393 96 | 381 359 | -4432 117 | -3662 -369 | 2413 -294 | 4375 -249 | 36900% |
| 253(E) | -1959 -149 -8 | -3457 -500 -8139 | -568 233 -9181 | 3135 43 -894 | -3841 -381 -1115 | -2347 399 -701 | -1410 106 -1378 | -3622 -626 * | -1165 210 * | -3547 -466 | -2751 -720 | -1000 275 | -2716 394 | 1879 45 | -1666 96 | -1757 359 | 692 117 | -3162 -369 | -3709 -294 | -2960 -249 | 37000% |
| 254(G) | -347 -149 -8 | -2818 -500 -8139 | -1215 233 -9181 | 201 43 -894 | -3253 -381 -1115 | 2635 399 -701 | -921 106 -1378 | -2921 -626 * | 1474 210 * | -2822 -466 | -1972 -720 | -1002 275 | -2459 394 | -486 45 | 658 96 | -1397 359 | -1435 117 | -2521 -369 | -2923 -294 | -2378 -249 | 37100% |
| 255(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 37200% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 256(I) | -2042 -149 -8 | -1769 -500 -8139 | -4321 233 -9181 | -3740 43 -894 | -1316 -381 -1115 | -3753 399 -701 | -2668 106 -1378 | 3134 -626 * | -3389 210 * | 1017 -466 | 1999 -720 | 194 275 | -3653 394 | -2958 45 | -3221 96 | -2884 359 | -1980 117 | -344 -369 | -2325 -294 | -2073 -249 | 37300% |
| 257(A) | 1914 -149 -8 | -1640 -500 -8139 | -1237 233 -9181 | 128 43 -894 | -1748 -381 -1115 | -661 399 -701 | -793 106 -1378 | -1355 -626 * | -577 210 * | -49 -466 | -817 -720 | -905 275 | -2155 394 | -498 45 | -993 96 | 1037 359 | 162 117 | -1149 -369 | -2002 -294 | 624 -249 | 37400% |
| 258(N) | 365 -149 -8 | -3809 -500 -8139 | 1001 233 -9181 | 557 43 -894 | -4083 -381 -1115 | 1196 399 -701 | -1518 106 -1378 | -3930 -626 * | -1535 210 * | -3838 -466 | -3055 -720 | 3219 275 | -2763 394 | -1148 45 | -2243 96 | -1845 359 | -2131 117 | -3433 -369 | -4027 -294 | -3144 -249 | 37500% |
| 259(M) | -3656 -149 -8 | -3159 -500 -8139 | -5816 233 -9181 | -5350 43 -894 | -1349 -381 -1115 | -5421 399 -701 | -4248 106 -1378 | -822 -626 * | -4928 210 * | 948 -466 | 4920 -720 | -5248 275 | -4838 394 | -4039 45 | -4539 96 | -4860 359 | -3558 117 | -1557 -369 | -3044 -294 | -3030 -249 | 37600% |
| 260(R) | -1614 -149 -8 | -1949 -500 -8139 | -2260 233 -9181 | -1663 43 -894 | -886 -381 -1115 | -2765 399 -701 | -1089 106 -1378 | -1596 -626 * | -1089 210 * | 360 -466 | -1133 -720 | 2239 275 | -2814 394 | -1215 45 | 2408 96 | -1789 359 | -1535 117 | -1468 -369 | 1995 -294 | 1546 -249 | 37700% |
| 261(Y) | -1548 -149 -8 | -2973 -500 -8139 | 568 233 -9181 | -509 43 -894 | -2846 -381 -1115 | -2207 399 -701 | 1172 106 -1378 | -2986 -626 * | 441 210 * | -2941 -466 | -2110 -720 | 1645 275 | -2446 394 | -659 45 | -1264 96 | -1389 359 | -1509 117 | -2582 -369 | -2924 -294 | 3695 -249 | 37800% |
| 262(S) | 279 -149 -8 | -1844 -500 -8139 | -3877 233 -9181 | -4131 43 -894 | -4448 -381 -1115 | 136 399 -701 | -3634 106 -1378 | -4260 -626 * | -4132 210 * | -4511 -466 | -3561 -720 | -2782 275 | -2903 394 | -3648 45 | -3936 96 | 3391 359 | -1692 117 | -3009 -369 | -4661 -294 | -4566 -249 | 37900% |
| 263(I) | -2653 -149 -8 | -2149 -500 -8139 | -5311 233 -9181 | -4961 43 -894 | -2538 -381 -1115 | -5114 399 -701 | -4905 106 -1378 | 2957 -626 * | -4891 210 * | 332 -466 | -1267 -720 | -4770 275 | -4827 394 | -4713 45 | -4978 96 | -4466 359 | -2636 117 | 2521 -369 | -4218 -294 | -3821 -249 | 38000% |
| 264(S) | -2212 -149 -8 | -2711 -500 -8139 | -4019 233 -9181 | -4348 43 -894 | -4697 -381 -1115 | -2899 399 -701 | -4045 106 -1378 | -4988 -626 * | -4527 210 * | -5102 -466 | -4364 -720 | -3492 275 | -3638 394 | -4203 45 | -4355 96 | 3681 359 | -2664 117 | -3902 -369 | -4616 -294 | -4605 -249 | 38100% |
| 265(N) | -2725 -149 -8 | -4778 -500 -8139 | 2906 233 -9181 | 990 43 -894 | -4896 -381 -1115 | -2486 399 -701 | -1922 106 -1378 | -4885 -626 * | -2320 210 * | -4718 -466 | -4140 -720 | 3045 275 | -3069 394 | -1612 45 | -3311 96 | -2334 359 | -2821 117 | -4325 -369 | -4919 -294 | -3794 -249 | 38200% |
| 266(T) | -2061 -149 -8 | -3396 -500 -8139 | -596 233 -9181 | 903 43 -894 | -4071 -381 -1115 | -2367 399 -701 | -1713 106 -1378 | -3874 -626 * | -1685 210 * | -3859 -466 | -3103 -720 | 2125 275 | -2850 394 | -1369 45 | -2277 96 | -1897 359 | 3157 117 | -3351 -369 | -4055 -294 | -3271 -249 | 38300% |
| 267(A) | 3410 -149 -8 | -2035 -500 -8139 | -3979 233 -9181 | -4290 43 -894 | -4573 -381 -1115 | 659 399 -701 | -3798 106 -1378 | -4400 -626 * | -4332 210 * | -4660 -466 | -3754 -720 | -2978 275 | -3080 394 | -3858 45 | -4099 96 | -1690 359 | -1908 117 | -3194 -369 | -4697 -294 | -4687 -249 | 38400% |
| 268(E) | -2118 -149 -8 | -3486 -500 -8139 | -1036 233 -9181 | 2964 43 -894 | -3935 -381 -1115 | -2588 399 -701 | -1284 106 -1378 | -3596 -626 * | 1878 210 * | -3417 -466 | -2636 -720 | -1209 275 | -2827 394 | 1323 45 | -773 96 | -1923 359 | -2032 117 | -3199 -369 | -3455 -294 | -2917 -249 | 38500% |
| 269(Y) | -4524 -149 -8 | -3618 -500 -8139 | -5100 233 -9181 | -5310 43 -894 | 1910 -381 -1115 | -4972 399 -701 | -1299 106 -1378 | -3522 -626 * | 634 210 * | -2951 -466 | -2965 -720 | -3649 275 | -4847 394 | -3741 45 | -4299 96 | -4199 359 | -4391 117 | -3637 -369 | 2997 -294 | 4211 -249 | 38600% |
| 270(G) | -4176 -155 -8 | -3995 -500 -8139 | -4855 233 -3345 | -5222 43 -894 | -5686 -381 -1115 | 3828 399 -701 | -4823 106 -1378 | -6386 -626 * | -5533 210 * | -6087 -466 | -5741 -720 | -4896 275 | -4606 394 | -5312 45 | -5178 96 | -4461 359 | -4560 117 | -5613 -369 | -4754 -294 | -5635 -249 | 38700% |
| 271(D) | -2710 -149 -8 | -4705 -500 -7992 | 3025 233 -9034 | 1828 43 -894 | -4880 -381 -1115 | 1758 399 -422 | -1932 106 -1980 | -4863 -626 * | -2320 210 * | -4703 -466 | -4115 -720 | -1084 275 | -3073 394 | -1621 45 | -3297 96 | -2330 359 | -2809 117 | -4301 -369 | -4894 -294 | -3793 -249 | 38800% |

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 272(Y) | -2497 -149 -8 | -2175 -500 -8139 | -4651 233 -9181 | -4137 43 -894 | 2447 -381 -1115 | -4046 399 -701 | -2215 106 -1378 | 255 -626 * | -3766 210 * | 892 -466 | 1558 -720 | -3537 275 | -3886 394 | -3109 45 | -3468 96 | -3181 359 | -2410 117 | -1282 -369 | -1615 -294 | 3508 -249 | 38900% |
| 273(V) | -1425 -149 -8 | -1250 -500 -8139 | -3480 233 -9181 | -2894 43 -894 | -1283 -381 -1115 | -3035 399 -701 | -1955 106 -1378 | 691 -626 * | -2570 210 * | -1 -466 | -429 -720 | -2568 275 | -3060 394 | 942 45 | -2514 96 | -2129 359 | 1701 117 | 2578 -369 | -1907 -294 | -1553 -249 | 39000% |
| 274(T) | 516 -149 -8 | -1643 -500 -8139 | -1918 233 -9181 | -1401 43 -894 | -2170 -381 -1115 | -2112 399 -701 | -1387 106 -1378 | -1759 -626 * | -1234 210 * | -2016 -466 | -1265 -720 | -1442 275 | -2421 394 | -1149 45 | 887 96 | 1341 359 | 2345 117 | 822 -369 | -2454 -294 | -2006 -249 | 39100% |
| 275(G) | 677 -149 -8 | -2128 -500 -8139 | -3838 233 -9181 | -4171 43 -894 | -4647 -381 -1115 | 3536 399 -701 | -3816 106 -1378 | -4506 -626 * | -4340 210 * | -4749 -466 | -3857 -720 | -3009 275 | -3149 394 | -3871 45 | -4137 96 | -1784 359 | -2005 117 | -3297 -369 | -4725 -294 | -4735 -249 | 39200% |
| 276(P) | -992 -149 -8 | -2210 -500 -8139 | 343 233 -9181 | -359 43 -894 | -2447 -381 -1115 | -1960 399 -701 | -675 106 -1378 | -2143 -626 * | 533 210 * | -2204 -466 | -1351 -720 | -651 275 | 2813 394 | -260 45 | -802 96 | 465 359 | -939 117 | -873 -369 | -2467 -294 | 1093 -249 | 39300% |
| 277(R) | -1214 -149 -8 | -2548 -500 -8139 | -1097 233 -9181 | 1072 43 -894 | 175 -381 -1115 | -2145 399 -701 | -716 106 -1378 | -2587 -626 * | 848 210 * | -2528 -466 | -1653 -720 | -795 275 | -2228 394 | -273 45 | 2862 96 | 417 359 | -1133 117 | -2191 -369 | -2671 -294 | -2084 -249 | 39400% |
| 278(V) | 289 -149 -8 | -2035 -500 -8139 | -5133 233 -9181 | -4789 43 -894 | -2692 -381 -1115 | -4777 399 -701 | -4639 106 -1378 | 2142 -626 * | -4689 210 * | -1561 -466 | -1443 -720 | -4511 275 | -4649 394 | -4585 45 | -4784 96 | -4102 359 | -2487 117 | 3125 -369 | -4202 -294 | -3717 -249 | 39500% |
| 279(I) | -2265 -149 -8 | -1919 -500 -8139 | -4828 233 -9181 | -4452 43 -894 | -2473 -381 -1115 | -4254 399 -701 | -3954 106 -1378 | 3155 -626 * | -4265 210 * | -1516 -466 | -1326 -720 | -4066 275 | -4279 394 | -4082 45 | -4274 96 | 226 359 | -2288 117 | 2182 -369 | -3688 -294 | -3250 -249 | 39600% |
| 280(D) | -1731 -149 -8 | -3162 -500 -8139 | 2329 233 -9181 | -550 43 -894 | -3318 -381 -1115 | -2239 399 -701 | -1273 106 -1378 | -3221 -626 * | -1145 210 * | -3214 -466 | -2403 -720 | 2295 275 | -2573 394 | -899 45 | -1742 96 | -1561 359 | 1851 117 | -2804 -369 | -3366 -294 | 1327 -249 | 39700% |
| 281(E) | 1097 -149 -8 | -2699 -500 -8139 | 1227 233 -9181 | 2368 43 -894 | -2994 -381 -1115 | -2011 399 -701 | -796 106 -1378 | -2753 -626 * | 381 210 * | -2704 -466 | -1808 -720 | -640 275 | -2190 394 | -358 45 | -992 96 | -1065 359 | -1162 117 | -2310 -369 | -2885 -294 | 1152 -249 | 39800% |
| 282(E) | -166 -149 -8 | -2372 -500 -8139 | 859 233 -9181 | 1835 43 -894 | -2692 -381 -1115 | -1861 399 -701 | 1182 106 -1378 | -2444 -626 * | 490 210 * | -2388 -466 | -1462 -720 | 590 275 | 478 394 | 1356 45 | -620 96 | 116 359 | -837 117 | -1994 -369 | -2555 -294 | -1871 -249 | 39900% |
| 283(T) | 228 -149 -8 | -1688 -500 -8139 | -3655 233 -9181 | -3444 43 -894 | -3179 -381 -1115 | -2145 399 -701 | -2891 106 -1378 | -2611 -626 * | -3215 210 * | -3076 -466 | -2328 -720 | -2557 275 | -2821 394 | -2916 45 | -3214 96 | 2251 359 | 2366 117 | 1397 -369 | -3549 -294 | -3270 -249 | 40000% |
| 284(K) | -2991 -149 -8 | -3623 -500 -8139 | -3848 233 -9181 | -2331 43 -894 | -4472 -381 -1115 | -3512 399 -701 | -1356 106 -1378 | -3763 -626 * | 2942 210 * | -3413 -466 | 1860 -720 | -2188 275 | -3430 394 | -937 45 | 2705 96 | -2874 359 | -2650 117 | -3556 -369 | -3267 -294 | -3189 -249 | 40100% |
| 285(E) | 443 -149 -8 | -2370 -500 -8139 | 732 233 -9181 | 1690 43 -894 | -2691 -381 -1115 | -1863 399 -701 | -526 106 -1378 | -2442 -626 * | 1639 210 * | -2385 -466 | -1460 -720 | -498 275 | -1960 394 | 1120 45 | 437 96 | 106 359 | -836 117 | -1992 -369 | -2552 -294 | -1869 -249 | 40200% |
| 286(A) | 1871 -149 -8 | -2286 -500 -8139 | -843 233 -9181 | 814 43 -894 | -2570 -381 -1115 | -1928 399 -701 | -578 106 -1378 | 269 -626 * | 1096 210 * | -2279 -466 | -1391 -720 | -586 275 | -2019 394 | -136 45 | 1056 96 | -62 359 | -881 117 | -1889 -369 | -2488 -294 | -1849 -249 | 40300% |
| 287(M) | -3656 -149 -8 | -3159 -500 -8139 | -5816 233 -9181 | -5350 43 -894 | -1349 -381 -1115 | -5421 399 -701 | -4248 106 -1378 | -822 -626 * | -4928 210 * | 948 -466 | 4920 -720 | -5248 275 | -4838 394 | -4039 45 | -4539 96 | -4860 359 | -3558 117 | -1557 -369 | -3044 -294 | -3030 -249 | 40400% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 288(K) | -1646 -149 -8 | -2891 -500 -8139 | -1591 233 -9181 | 287 43 -894 | -3346 -381 -1115 | -526 399 -701 | -912 106 -1378 | -2971 -626 * | 2831 210 * | -2832 -466 | -1997 -720 | -1146 275 | -2554 394 | -472 45 | 1762 96 | -1527 359 | -1524 117 | -2597 -369 | -2885 -294 | 1245 -249 | 40500% |
| 289(E) | -172 -149 -8 | -2394 -500 -8139 | 367 233 -9181 | 2205 43 -894 | -2713 -381 -1115 | -487 399 -701 | -545 106 -1378 | -2465 -626 * | -134 210 * | -2409 -466 | -1485 -720 | 1305 275 | -1975 394 | 663 45 | 831 96 | -795 359 | 72 117 | -2015 -369 | -2577 -294 | -1891 -249 | 40600% |
| 290(C) | 1574 -149 -8 | 3024 -500 -8139 | -4584 233 -9181 | -4122 43 -894 | -2155 -381 -1115 | -3932 399 -701 | -3330 106 -1378 | 1746 -626 * | -3870 210 * | -1406 -466 | -1109 -720 | -3691 275 | -3957 394 | -3613 45 | -3805 96 | -3144 359 | -2046 117 | 2342 -369 | -3118 -294 | -2720 -249 | 40700% |
| 291(L) | -187 -149 -8 | -2175 -500 -8139 | -4307 233 -9181 | -3889 43 -894 | -898 -381 -1115 | -3779 399 -701 | -2344 106 -1378 | -944 -626 * | -3485 210 * | 2855 -466 | -476 -720 | -3390 275 | -3782 394 | -3025 45 | -3298 96 | -2972 359 | -2345 117 | -1269 -369 | -1846 -294 | 1565 -249 | 40800% |
| 292(K) | 862 -149 -8 | -2347 -500 -8139 | 143 233 -9181 | 1211 43 -894 | -2665 -381 -1115 | -1855 399 -701 | 873 106 -1378 | -2414 -626 * | 1692 210 * | -2362 -466 | 917 -720 | -492 275 | -1949 394 | 889 45 | -603 96 | -763 359 | 783 117 | -1968 -369 | -2532 -294 | -1851 -249 | 40900% |
| 293(D) | -2148 -149 -8 | -3878 -500 -8139 | 2790 233 -9181 | 1765 43 -894 | -4119 -381 -1115 | -2356 399 -701 | -1511 106 -1378 | -3962 -626 * | -1467 210 * | -3852 -466 | -3075 -720 | 24 275 | -2782 394 | -1139 45 | 2142 96 | -1879 359 | -2163 117 | -3473 -369 | -4024 -294 | -3155 -249 | 41000% |
| 294(I) | -2630 -149 -8 | -2131 -500 -8139 | -5302 233 -9181 | -4991 43 -894 | -2737 -381 -1115 | -5092 399 -701 | -5106 106 -1378 | 3464 -626 * | -4941 210 * | -1495 -466 | -1447 -720 | -4789 275 | -4862 394 | -4869 45 | -5086 96 | -4473 359 | -2627 117 | 2071 -369 | -4467 -294 | -3968 -249 | 41100% |
| 295(Q) | 346 -149 -8 | -3134 -500 -8139 | -1818 233 -9181 | -1401 43 -894 | -3862 -381 -1115 | -2760 399 -701 | -1314 106 -1378 | -3433 -626 * | 1329 210 * | -3271 -466 | -2513 -720 | -1545 275 | -2936 394 | 3817 45 | -430 96 | -2018 359 | -2031 117 | -3060 -369 | -3278 -294 | -2908 -249 | 41200% |
| 296(S) | -1354 -149 -8 | -2895 -500 -8139 | 1712 233 -9181 | 354 43 -894 | -3192 -381 -1115 | -2068 399 -701 | -914 106 -1378 | -2967 -626 * | -621 210 * | -2903 -466 | -2012 -720 | 1817 275 | -2288 394 | 724 45 | -1177 96 | 1978 359 | -96 117 | -2508 -369 | -3076 -294 | -2340 -249 | 41300% |
| 297(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 41400% |
| 298(E) | -437 -149 -8 | -2374 -500 -8139 | -769 233 -9181 | 2013 43 -894 | -2697 -381 -1115 | -1895 399 -701 | -552 106 -1378 | -2438 -626 * | 623 210 * | -2389 -466 | -1472 -720 | -536 275 | -1991 394 | -97 45 | 777 96 | 829 359 | 1488 117 | -1999 -369 | -2559 -294 | -1890 -249 | 41500% |
| 299(F) | -4347 -149 -8 | -3577 -500 -8139 | -4619 233 -9181 | 543 43 -894 | 3858 -381 -1115 | -4820 399 -701 | -1320 106 -1378 | -3438 -626 * | -4609 210 * | -2900 -466 | -2894 -720 | -3532 275 | -4750 394 | -3628 45 | -4209 96 | -4078 359 | -4237 117 | -3546 -369 | -601 -294 | 2917 -249 | 41600% |
| 300(A) | 2827 -149 -8 | -1603 -500 -8139 | -4068 233 -9181 | -3628 43 -894 | -2047 -381 -1115 | -3165 399 -701 | -2823 106 -1378 | 1205 -626 * | -3349 210 * | -1486 -466 | -1089 -720 | -3103 275 | -3432 394 | -3073 45 | -3298 96 | -2387 359 | 197 117 | 1100 -369 | -2812 -294 | -2447 -249 | 41700% |
| 301(K) | -2364 -149 -8 | -3363 -500 -8139 | -2464 233 -9181 | 163 43 -894 | -4038 -381 -1115 | -3041 399 -701 | -1188 106 -1378 | -3501 -626 * | 2928 210 * | -3234 -466 | -2487 -720 | -1693 275 | -3047 394 | -758 45 | 2488 96 | -458 359 | -2152 117 | -3194 -369 | -3159 -294 | -2895 -249 | 41800% |
| 302(M) | -893 -149 -8 | -2361 -500 -8139 | 740 233 -9181 | 1780 43 -894 | -2680 -381 -1115 | -537 399 -701 | -524 106 -1378 | -2429 -626 * | 930 210 * | -2376 -466 | 1895 -720 | -498 275 | -1958 394 | -66 45 | 722 96 | 775 359 | -833 117 | -1982 -369 | -2545 -294 | -1864 -249 | 41900% |
| 303(W) | -2965 -149 -8 | -2553 -500 -8139 | -4795 233 -9181 | -4482 43 -894 | 3045 -381 -1115 | -4315 399 -701 | -1779 106 -1378 | -1426 -626 * | -4093 210 * | 92 -466 | -987 -720 | -3564 275 | -4179 394 | -3330 45 | -3743 96 | -3475 359 | -2878 117 | 664 -369 | 4754 -294 | -84 -249 | 42000% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 304(I) | -2621 -149 -8 | -2136 -500 -8139 | -5246 233 -9181 | -4859 43 -894 | -2364 -381 -1115 | -4987 399 -701 | -4577 106 -1378 | 3052 -626 * | -4747 210 * | -250 -466 | 1043 -720 | -4641 275 | -4713 394 | -4488 45 | -4769 96 | -4301 359 | -2597 117 | 2384 -369 | -3934 -294 | -3596 -249 | 42100% |
| 305(L) | 684 -149 -8 | -1319 -500 -8139 | -1741 233 -9181 | 761 43 -894 | -1375 -381 -1115 | -2223 399 -701 | -1037 106 -1378 | -927 -626 * | -1042 210 * | 1693 -466 | -533 -720 | -1287 275 | -2325 394 | -915 45 | -1349 96 | 767 359 | -152 117 | 84 -369 | -1756 -294 | -1329 -249 | 42200% |
| 306(E) | 364 -149 -8 | -4165 -500 -8139 | 621 233 -9181 | 3314 43 -894 | -4393 -381 -1115 | -2398 399 -701 | -1686 106 -1378 | -4282 -626 * | -1836 210 * | -4169 -466 | -3446 -720 | 728 275 | -2893 394 | -1339 45 | -2626 96 | -2045 359 | -2402 117 | -3767 -369 | -4362 -294 | -3401 -249 | 42300% |
| 307(N) | -939 -149 -8 | 979 -500 -8139 | -1235 233 -9181 | -681 43 -894 | -1738 -381 -1115 | 1352 399 -701 | 935 106 -1378 | -1357 -626 * | -549 210 * | -1572 -466 | -816 -720 | 2186 275 | -2155 394 | -482 45 | 165 96 | -1022 359 | -880 117 | 30 -369 | -1990 -294 | 1446 -249 | 42400% |
| 308(Q) | 667 -149 -8 | -2393 -500 -8139 | -773 233 -9181 | 511 43 -894 | -2721 -381 -1115 | -316 399 -701 | -544 106 -1378 | -2465 -626 * | 1211 210 * | -2405 -466 | -1484 -720 | 584 275 | -1989 394 | 2135 45 | 1528 96 | -812 359 | -868 117 | -2019 -369 | -2566 -294 | -1895 -249 | 42500% |
| 309(A) | 2050 -149 -8 | -1857 -500 -8139 | -1081 233 -9181 | -526 43 -894 | -2013 -381 -1115 | -2012 399 -701 | 188 106 -1378 | -1645 -626 * | -385 210 * | -1213 -466 | -1011 -720 | 486 275 | -2103 394 | -346 45 | 1657 96 | -953 359 | 306 117 | -261 -369 | -2169 -294 | -1624 -249 | 42600% |
| 310(G) | -1848 -149 -8 | -2469 -500 -8139 | -2089 233 -9181 | -2292 43 -894 | 1262 -381 -1115 | 2944 399 -701 | -2358 106 -1378 | -3563 -626 * | -2904 210 * | -3628 -466 | -3017 -720 | 2347 275 | -3167 394 | -2550 45 | -3185 96 | -1986 359 | -2162 117 | -3006 -369 | -2814 -294 | -1874 -249 | 42700% |
| 311(Y) | 475 -149 -8 | 1019 -500 -8139 | -1606 233 -9181 | -1042 43 -894 | 225 -381 -1115 | -2192 399 -701 | -935 106 -1378 | -946 -626 * | -891 210 * | -1226 -466 | 1222 -720 | 357 275 | -2267 394 | 1002 45 | 1577 96 | -1172 359 | -888 117 | -800 -369 | -1730 -294 | 2446 -249 | 42800% |
| 312(P) | -87 -149 -8 | -2372 -500 -8139 | -1362 233 -9181 | 756 43 -894 | 1726 -381 -1115 | -2205 399 -701 | -2007 106 -1378 | -3445 -626 * | -1924 210 * | -3575 -466 | -2761 -720 | -1555 275 | 3598 394 | -1697 45 | -2362 96 | -1566 359 | 286 117 | -2803 -369 | -3832 -294 | -3277 -249 | 42900% |
| 313(K) | -2336 -149 -8 | -1920 -500 -8139 | -4499 233 -9181 | -3891 43 -894 | -1920 -381 -1115 | -3822 399 -701 | -2504 106 -1378 | -645 -626 * | -3523 210 * | 1973 -466 | 3030 -720 | -3442 275 | -3673 394 | -2938 45 | -3257 96 | -2944 359 | -2114 117 | 2017 -369 | -2014 -294 | 1662 -249 | 43000% |
| 314(E) | -804 -149 -8 | -1483 -500 -8139 | 621 233 -9181 | -230 43 -894 | -1920 -381 -1115 | -1863 399 -701 | 1714 106 -1378 | -647 -626 * | 1272 210 * | -2322 -466 | -1408 -720 | 1011 275 | 472 394 | -69 45 | 433 96 | -772 359 | 1411 117 | 326 -369 | -2507 -294 | -1836 -249 | 43100% |
| 315(T) | -883 -149 -8 | -2314 -500 -8139 | -747 233 -9181 | 517 43 -894 | -2618 -381 -1115 | -1335 399 -701 | -101 106 -1378 | -1605 -626 * | 2889 210 * | -1630 -466 | -1021 -720 | -349 275 | -1569 394 | 232 45 | 698 96 | -786 359 | -759 117 | -1358 -369 | -1637 -294 | -1317 -249 | 43200% |
| 316(M) | -38 -149 -8 | -5840 -500 -8139 | -6882 233 -9181 | 2831 43 -894 | -2050 -381 -1115 | -3098 399 -701 | -179 106 -3775 | -1804 -626 * | -118 210 * | -1919 -466 | -1331 -720 | 69 275 | -1441 394 | -4 45 | -527 96 | -653 359 | -814 117 | -1512 -369 | -1988 -294 | -1505 -249 | 43300% |
| 317(H) | -766 -149 -38 | -1695 -500 -5840 | 521 233 -6882 | -367 43 -894 | -2714 -381 -1115 | -1029 399 -701 | -293 106 -1378 | -2459 -626 * | -171 210 * | -2415 -466 | -1499 -720 | 414 275 | -2004 394 | -128 45 | 839 96 | 1365 359 | 1730 117 | -2017 -369 | -2592 -294 | -1915 -249 | 43400% |
| 318(A) | -942 -149 -8 | -2382 -500 -8139 | -739 233 -9181 | 1086 43 -894 | -2714 -381 -1115 | -109 399 -701 | -581 106 -1378 | -647 -626 * | -3523 210 * | -2322 -466 | -1408 -720 | -3442 275 | -3673 394 | -2938 45 | -3257 96 | -2944 359 | -2114 117 | 2017 -369 | -2014 -294 | 1662 -249 | 43500% |
| 319(M) | 2474 -149 -8 | -2397 -500 -8139 | -816 233 -9181 | -367 43 -894 | -2797 -381 -1115 | -273 399 -701 | -722 106 -1378 | -647 -626 * | 555 210 * | -2507 -466 | -1610 -720 | 592 275 | -2110 394 | 837 45 | -805 96 | -138 359 | -1006 117 | -299 -369 | -2699 -294 | -2039 -249 | 43600% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 320(R) | -1311 -149 -8 | -2432 -500 -8139 | -1349 233 -9181 | -724 43 -894 | -2724 -381 -1115 | -2272 399 -701 | -799 106 -1378 | -2361 -626 * | 613 210 * | -644 -466 | 1079 -720 | 976 275 | 597 394 | -382 45 | 2908 96 | -1246 359 | -1219 117 | -2044 -369 | -2579 -294 | -2061 -249 | 43700% |
| 321(R) | 897 -149 -8 | -2364 -500 -8139 | -833 233 -9181 | 905 43 -894 | -2678 -381 -1115 | -1930 399 -701 | -568 106 -1378 | -2405 -626 * | 1293 210 * | -2366 -466 | 1485 -720 | -575 275 | -2020 394 | -177 45 | 2045 96 | 95 359 | -893 117 | -1984 -369 | -2543 -294 | -1892 -249 | 43800% |
| 322(N) | 505 -149 -8 | -2300 -500 -8139 | -750 233 -9181 | 523 43 -894 | -2598 -381 -1115 | 121 399 -701 | -525 106 -1378 | -594 -626 * | 485 210 * | 95 -466 | -1395 -720 | 1720 275 | -1957 394 | 348 45 | 224 96 | 551 359 | -821 117 | -1910 -369 | -2497 -294 | -1828 -249 | 43900% |
| 323(E) | 444 -149 -8 | -2266 -500 -8139 | -766 233 -9181 | 1488 43 -894 | -2551 -381 -1115 | -1871 399 -701 | -533 106 -1378 | -2276 -626 * | 889 210 * | -2266 -466 | 1474 -720 | 1478 275 | -1963 394 | 682 45 | -629 96 | -781 359 | 12 117 | -279 -369 | -2472 -294 | 476 -249 | 44000% |
| 324(N) | 1511 -149 -8 | -1770 -500 -8139 | -728 233 -9181 | -204 43 -894 | -2244 -381 -1115 | -1781 399 -701 | -426 106 -1378 | 282 -626 * | 601 210 * | -2121 -466 | -1133 -720 | 1769 275 | -1827 394 | 1398 45 | 447 96 | -748 359 | -766 117 | -1713 -369 | -1779 -294 | -1595 -249 | 44100% |
| 325(N) | 1053 -149 -8 | -3109 -500 -8139 | 1756 233 -9181 | 1735 43 -894 | -3404 -381 -1115 | -2143 399 -701 | -1074 106 -1378 | -3191 -626 * | -846 210 * | -3124 -466 | -2254 -720 | 2158 275 | -2417 394 | -657 45 | -1430 96 | -1361 359 | 197 117 | -2727 -369 | -3303 -294 | -2540 -249 | 44200% |
| 326(H) | -2064 -149 -8 | -3071 -500 -8139 | -1245 233 -9181 | -1267 43 -894 | -3262 -381 -1115 | -2570 399 -701 | 4711 106 -1378 | -3611 -626 * | -1060 210 * | -3528 -466 | -2812 -720 | -1479 275 | -2961 394 | 1288 45 | -1287 96 | 670 359 | -2133 117 | -3161 -369 | -3310 -294 | -2601 -249 | 44300% |
| 327(Q) | -891 -149 -8 | -2294 -500 -8139 | 332 233 -9181 | 948 43 -894 | -2585 -381 -1115 | -739 399 -701 | -537 106 -1378 | -2316 -626 * | -131 210 * | -138 -466 | -1391 -720 | -518 275 | 1404 394 | 2021 45 | -634 96 | -785 359 | 619 117 | -561 -369 | -2495 -294 | -1830 -249 | 44400% |
| 328(I) | -1632 -149 -8 | -1661 -500 -8139 | -2846 233 -9181 | -86 43 -894 | -1626 -381 -1115 | -2983 399 -701 | -1663 106 -1378 | 3240 -626 * | -1327 210 * | -191 -466 | -722 -720 | -2160 275 | -3016 394 | -1615 45 | 822 96 | -2097 359 | -1556 117 | -560 -369 | -2157 -294 | -1805 -249 | 44500% |
| 329(E) | -2734 -149 -8 | -3605 -500 -8139 | -1382 233 -9181 | 3593 43 -894 | -3624 -381 -1115 | -2986 399 -701 | -2317 106 -1378 | -3317 -626 * | -2175 210 * | -3167 -466 | 1983 -720 | -1898 275 | -3440 394 | -2054 45 | -2556 96 | -2649 359 | -2820 117 | -3234 -369 | -3920 -294 | -3370 -249 | 44600% |
| 330(W) | -2336 -149 -38 | -1265 -500 -8139 | -2068 233 -325 | -1964 43 -894 | 479 -381 -1115 | -1810 399 -109 | -483 106 -3775 | -1181 -626 * | -1470 210 * | -968 -466 | -802 -720 | -1648 275 | -2104 394 | -1454 45 | -1405 96 | -1757 359 | -1583 117 | -1218 -369 | 5462 -294 | 838 -249 | 44700% |
| 331(K) | -1530 -149 -8 | -2067 -500 -8139 | -905 233 -9181 | 437 43 -894 | -2275 -381 -1115 | -1941 399 -701 | -611 106 -1378 | -307 -626 * | 2031 210 * | -2031 -466 | -1189 -720 | -636 275 | -2030 394 | 1425 45 | -709 96 | -864 359 | -350 117 | 1337 -369 | -2323 -294 | -1722 -249 | 44800% |
| 332(V) | -2445 -149 -8 | -2012 -500 -8139 | -5067 233 -9181 | -4708 43 -894 | -2628 -381 -1115 | -4682 399 -701 | -4459 106 -1378 | 1586 -626 * | -4580 210 * | -1533 -466 | -1402 -720 | -4414 275 | -4575 394 | -4456 45 | -4653 96 | -3990 359 | 1117 117 | 3227 -369 | -4065 -294 | -3597 -249 | 44900% |
| 333(G) | -4435 -149 -8 | -4203 -500 -8139 | -5092 233 -9181 | -5462 43 -894 | -5893 -381 -1115 | 3834 399 -701 | -5028 106 -1378 | -6627 -626 * | -5765 210 * | -6297 -466 | -5970 -720 | -5141 275 | -4804 394 | -5546 45 | -5385 96 | -4727 359 | -4815 117 | -5862 -369 | -4924 -294 | -5849 -249 | 45000% |
| 334(E) | 1477 -149 -8 | -2744 -500 -8139 | -762 233 -9181 | 2410 43 -894 | -3114 -381 -1115 | -2113 399 -701 | -884 106 -1378 | -2850 -626 * | -445 210 * | -2792 -466 | -1912 -720 | 619 275 | -2297 394 | -451 45 | 1346 96 | -1191 359 | -1280 117 | -2412 -369 | -2952 -294 | -2288 -249 | 45100% |
| 335(K) | -1204 -149 -8 | -2643 -500 -8139 | 366 233 -9181 | 1309 43 -894 | -2998 -381 -1115 | -2086 399 -701 | -724 106 -1378 | -2722 -626 * | 2626 210 * | -2637 -466 | -1741 -720 | -718 275 | -2200 394 | 1198 45 | 862 96 | -1073 359 | -1133 117 | -2287 -369 | -2770 -294 | -2133 -249 | 45200% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 336(L) | -3571 -149 -8 | -3023 -500 -8139 | -5954 233 -9181 | -5375 43 -894 | -1321 -381 -1115 | -5646 399 -701 | -4390 106 -1378 | -632 -626 * | -5138 210 * | 2962 -466 | 1671 -720 | -5358 275 | -4852 394 | -4044 45 | -4689 96 | -4963 359 | -3436 117 | 742 -369 | -3082 -294 | -3239 -249 | 45300% |
| 337(R) | -4845 -149 -8 | -4446 -500 -8139 | -5107 233 -9181 | -4682 43 -894 | -5507 -381 -1115 | -4412 399 -701 | -3791 106 -1378 | -5946 -626 * | -2789 210 * | -5502 -466 | -5118 -720 | -4521 275 | -4754 394 | -3672 45 | 4219 96 | -4989 359 | -4832 117 | -5644 -369 | -4538 -294 | -4993 -249 | 45400% |
| 338(E) | 943 -149 -8 | -2422 -500 -8139 | 1002 233 -9181 | 1200 43 -894 | -2741 -381 -1115 | 377 399 -701 | -572 106 -1378 | -2493 -626 * | 982 210 * | -2439 -466 | -1517 -720 | -522 275 | -1998 394 | -117 45 | -681 96 | 1129 359 | -534 117 | -2044 -369 | -2609 -294 | -1921 -249 | 45500% |
| 339(M) | -3391 -149 -8 | -2886 -500 -8139 | -5774 233 -9181 | -5202 43 -894 | -1338 -381 -1115 | -5407 399 -701 | -4210 106 -1378 | -576 -626 * | -4943 210 * | 1721 -466 | 4369 -720 | -5109 275 | -4742 394 | -3963 45 | -4548 96 | -4689 359 | -3273 117 | 771 -369 | -3038 -294 | -3137 -249 | 45600% |
| 340(M) | -1812 -149 -8 | -1601 -500 -8139 | -3997 233 -9181 | -3375 43 -894 | 696 -381 -1115 | -3401 399 -701 | -2222 106 -1378 | -516 -626 * | -2983 210 * | 441 -466 | 4360 -720 | -2991 275 | -3334 394 | -2559 45 | 641 96 | -2503 359 | -1740 117 | 404 -369 | -1934 -294 | -1661 -249 | 45700% |
| 341(P) | 102 -149 -8 | -1789 -500 -8139 | -1729 233 -9181 | -1313 43 -894 | 428 -381 -1115 | -2112 399 -701 | -1410 106 -1378 | -2021 -626 * | -1236 210 * | -2235 -466 | -1470 -720 | -1394 275 | 3205 394 | 695 45 | -1607 96 | 703 359 | -1207 117 | -1700 -369 | -2613 -294 | -2121 -249 | 45800% |
| 342(W) | -3486 -149 -259 | -3022 -500 -8139 | -4312 233 -2637 | -4121 43 -894 | 1891 -381 -1115 | -4228 399 -701 | -1173 106 -1378 | -2749 -626 * | 310 210 * | -2389 -466 | -2250 -720 | -3147 275 | -4206 394 | -2971 45 | -3005 96 | -3484 359 | -3396 117 | -2818 -369 | 5644 -294 | 611 -249 | 45900% |
| 343(I) | -2220 -149 -239 | -1737 -500 -7889 | -4860 233 -2749 | -4531 43 -894 | -2271 -381 -1115 | -4617 399 -701 | -4497 106 -583 | 3348 -626 * | -4448 210 * | -1059 -466 | -1008 -720 | -4311 275 | -4407 394 | -4340 45 | -4559 96 | -3974 359 | -2216 117 | 2150 -369 | -3915 -294 | -3445 -249 | 46000% |
| 344(A) | 1699 -149 -114 | -2218 -500 -7660 | -3820 233 -8795 | -33 43 -894 | -2555 -381 -1115 | -1149 399 -701 | -865 106 -413 | -2304 -626 * | 1212 210 * | -2260 -466 | -1348 -720 | 582 275 | -1822 394 | 37 45 | -536 96 | 966 359 | -724 117 | -1859 -369 | -2439 -294 | -1755 -249 | 46100% |
| 345(A) | 1523 -149 -10 | -2068 -500 -7753 | 532 233 -8991 | 154 43 -894 | -921 -381 -1115 | -553 399 -701 | -413 106 -1111 | 1384 -626 * | 247 210 * | 1472 -466 | -100 -720 | -1202 275 | -2134 394 | -805 45 | 485 96 | -1085 359 | -677 117 | -123 -369 | -1340 -294 | -1732 -249 | 46200% |
| 346(N) | -1650 -149 -9 | -3264 -500 -7949 | -8795 233 -8991 | -231 43 -894 | -2383 -381 -1115 | 1040 399 -701 | -522 106 -1059 | -2084 -626 * | 928 210 * | -2120 -466 | -1245 -720 | -517 275 | -1922 394 | 1335 45 | -611 96 | 251 359 | -768 117 | -2887 -369 | -2361 -294 | -2662 -249 | 46300% |
| 347(K) | -1650 -149 -193 | -2932 -500 -7842 | 1760 233 -3049 | -348 43 -894 | -3555 -381 -1115 | -230 399 -701 | -1131 106 -668 | -3362 -626 * | 324 210 * | -3285 -466 | -2448 -720 | 2847 275 | 1624 394 | -733 45 | -1607 96 | -1438 359 | -1645 117 | -2848 -369 | -3466 -294 | -2610 -249 | 46400% |
| 348(L) | 150 -149 -11 | -2932 -500 -7660 | -2433 233 -9088 | -1483 43 -894 | -3710 -381 -1115 | -2747 399 -701 | -907 106 -479 | -3141 -626 * | 3369 210 * | -2897 -466 | -2178 -720 | -1487 275 | -2774 394 | -488 45 | 1175 96 | -1994 359 | -1888 117 | 471 -369 | -2822 -294 | -944 -249 | 46500% |
| 349(V) | -740 -149 -11 | -922 -500 -7660 | -1768 233 -8702 | 154 43 -894 | -921 -381 -1115 | -1824 399 -701 | -829 106 -1711 | 1384 -626 * | 247 210 * | 1472 -466 | -100 -720 | -1202 275 | -2134 394 | -805 45 | 485 96 | -1085 359 | -677 117 | 471 -369 | -1340 -294 | -1344 -249 | 46600% |
| 350(D) | 138 -149 -9 | -1046 -500 -7842 | -3186 233 -8885 | -2599 43 -894 | -1089 -381 -1115 | -2803 399 -701 | -1711 106 -2109 | 589 -626 * | 645 210 * | 945 -466 | -236 -720 | -2305 275 | -2830 394 | -2012 45 | -2236 96 | -1892 359 | -1154 117 | 2537 -369 | -1701 -294 | -3117 -249 | 46700% |
| 351(K) | -2086 -149 -8 | -3722 -500 -8046 | 2888 233 -9088 | 1158 43 -894 | -4001 -381 -1115 | 1601 399 -701 | -1510 106 -1378 | -3811 -626 * | -1573 210 * | -3773 -466 | -3018 -720 | -904 275 | -2733 394 | -1154 45 | -2294 96 | -1833 359 | -2125 117 | 575 -369 | -3993 -294 | -1812 -249 | 46800% |

TABLE Z-continued

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 352(D) | 898 | −1911 | 1604 | −335 | −2089 | −1892 | −573 | −1746 | 489 | −144 | 811 | −609 | 34 | −182 | −708 | 541 | −74 | −281 | −2188 | −1605 | 46900% |
| | −149 | −500 | 233 | 43 | −381 | 399 | 106 | −626 | 210 | −466 | −720 | 275 | 394 | 45 | 96 | 359 | 117 | −369 | −294 | −249 | |
| | −10 | −7745 | −8787 | −894 | −1115 | −701 | −1378 | * | * | | | | | | | | | | | | |
| 353(K) | −1676 | −2544 | −1956 | −1135 | −2823 | −2531 | −800 | −2469 | 2955 | −2426 | −1683 | −1240 | −2548 | −407 | 1469 | −1628 | −1517 | −119 | −2497 | 1619 | 47000% |
| | −149 | −500 | 233 | 43 | −381 | 399 | 106 | −626 | 210 | −466 | −720 | 275 | 394 | 45 | 96 | 359 | 117 | −369 | −294 | −249 | |
| | −11 | −7649 | −8691 | −894 | −1115 | −701 | −1378 | * | * | | | | | | | | | | | | |
| 354(N) | −1074 | −1925 | −1092 | −1190 | −3523 | −1781 | −1760 | −3345 | −1701 | −3432 | −2589 | 3429 | 1327 | −1460 | −2119 | 1182 | −1362 | −2558 | −3601 | −3046 | 47100% |
| | * | * | * | * | * | * | * | * | 0 | * | * | * | * | * | * | * | * | * | * | * | |

HMMER2.0 [2.2 g]  File format version: a unique identifier for this save file format.
NAME Functionally Verified KARIs  Name of the profile HMM
LENG 354  Model length: the number of match states in the model.
ALPH Amino  Symbol alphabet: This determines the symbol alphabet and the size of the symbol emission probability distributions. IAmino, the alphabet size is set to 20 and the symbol alphabet to "ACDEFGHIKLMNPQRSTVWY" (alphabetic order).
MAP yes  Map annotation flag: If set to yes, each line of data for the match state/consensus column in the main section of the file is followed by an extra number. This number gives the index of the alignment column that the match state was made from. This information provides a "map" of the match states (1..M) onto the columns of the alignment (1..alen). It is used for quickly aligning the model back to the original alignment, e.g. when using hmmalign-mapali.
COM hmmbuild-n Functionally Verified KARIs  Command line for every HMMER command that modifies the save file: This one means that hmmbuild (default patrameters) was applied to
exp-KARI.hmm exp-KARI_mod.aln  generate the save file.
COM hmmcalibrate exp-KARI.hmm  Command line for every HMMER command that modifies the save file: This one means that hmmcalibrate (default parameters) was applied to the save profile.
NSEQ 25  Sequence number: the number of sequences the HMM was trained on
DATE Mon Dec 8 17:34:51 2008  Creation date: When was the save file was generated.
XT −8455 −4 −1000 −1000 −8455 −4 −8455 −4  Eight "special" transitions for controlling parts of the algorithm-specific parts of the Plan7 model. The null probability used to convert these back to model probabilities is 1.0. The order of the eight fields is N->B, N->N, E->C, E->J, C->T, C->C, J->B, J->J.
NULT −4 −8455  The transition probability distribution for the null model (single G state).
NULE 595 −1558 85 338 −294 453 −1158 197 249  The extreme value distribution parameters μ and lambda respectively; both floating point values. These values are set when the model is
902 −1085 −142 −21 −313 45 531 201 384 −1998 −644  calibrated with hmmcalibrate. They are used to determine E-values of bit scores.
EVD −333.712708 0.110102

SEQUENCE LISTING (965 sequences)

SEQ ID NO: 1 - protein, 335 aa, Sulfolobus solfataricus
MKCTSKIYTDNDANLDLIKGKRIAVLGYGSQGRAWAQNLRDSGLNVVVGLEREGKSWELAKSDGITPLHTKDAVKDADIIIFLVPDMVQRTLWLESVQPYMKKGADLVFAHGFNIHYKLIDPPKDSDVYMIAPKGPGPTVREYYKAGGGVPALVAVHQDVSGTALHKALAIAKGIGATRAGVIPTTFKEETETDLFGEQVILVGGIMELMRAAFETLVEEGYQPEVAYFETINELKMLVDLVYEKGISGMLKAVSDTAKYGGMTVGKFVIDESVRKRMKEALQRIKSGKFAEEWVEEYGRGMPTVVNGLSNVQNSLEEKIGNQLRDLVQKGKPKS

SEQ ID NO: 2 - protein, 328 aa, Pyrobaculum aerophilum
MAKIYTDREASLEPLKGKTIAVIGYGIQGRAQALNLRDSGLEVIIGLRRGGKSWELATSEGFRVYEIGEAVRKADVILVLIPDMEQPKVWQEQIAPNLKEGVVVDFAHGFNVHFGLIKPPKNIDVIMVAPKAPGKAVREEYLAGRGVPALVAVYQDYSGSALKYALALAKGIGATRAGVIETTFAEETETDLIGEQIVLVGGLMELIKKGFEVLVEMGYQPEVAYFEVLNEAKLIMDLIWQRGIYGMLNGVSDTAKYGGLTVGPRVIDENVKRKMKEAAMRVKSGEFAKEWVEEYNRGAPTLRKLMEEARTHPIEKVGEEMRKLLFGP

SEQ ID NO: 3 - protein, 338 aa, Ralstonia solanacearum
MKVFYDKDADLSLIKGKNVTIIGYGSQGHAHALNLNDSGVKVTVGLRKNGASWNKAVNAGLQVKEVAEAVKDADVVMILLPDEQIADVYKNEVHGNIKQGAALAFAHGFNVHYGAVIPRADLDVIMVAPKAPGHTVRGTYAQGGGVPHLIAVHQDKSGSARDIALSYATANGGGRAGIIETNFREETETDLFGEQAVLCGGTVELIKAGFETLVEAGYAPEMAYFECLHELKLIVDLIYEGGIGNMNYSISNNAEYGEYVTGPRVVTAETKQAMKQCLHDIQTGEYAKSFLLENKAGAPTLISRRRLTADHQIEQVGAKLRAMMPWIAKNKLVDQSKN

SEQ ID NO: 4 - protein, 338 aa, Pseudomonas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 5 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 6 - protein, 338 aa, Spinacia oleracea; identical to SEQ ID NO: 4

SEQ ID NO: 7 - protein, 331 aa, Natronomonas pharaanis
MTDATIYYDDDAESTVLDDKTVAVLGYGSQGHAHAQNLDDSGVDVVVGLREDSSSRSAAEADGLDVATPRGAAEQADLVSVLVPDTVQPAVYEQIEDVLQPGDTLQFAHGFNIHYGQIEPSEDVNVTMVAPKSPGHLVRRNYENDEGTPGLLAVYQDPSGEAHDLGLAYAKAIGCTRAGVVETTFREETETDLFGEQAVLCGGVTSLVKTGYETLVDAGYSPEMAYFECLNELKLIVDLMYEGGNSEMWDSVSDTAEYGGLTRGDRIVDDHAREKMEEVLEEVQNGTFAREWISENQAGRPSYKQLRAAEKNHDIEAVGEDLRALFAWGDD

SEQ ID NO: 8 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 9 - protein, 338 aa, Corynebacterium glutamicun
MAIELLYDADADLSLIQGRKVAIVGYGSQGHAHSQNLRDSGVEVVIGLREGSKSAEKAKEAGFEVKTTAEAAAWADVIMLLAPDTSQAEIFTNDIEPNLNAGDALLFGHGLNIHFDLIKPADDIIVGMVAPKGPGHLVRRQFVDGKGVPCLIAVDQDPTGTAQALTLSYAAAIGGARAGVIPTTFEAETVTDLFGEQAVLCGGTEELVKVGFEVLTEAGYEPEMAYFEVLHELKLIVDLMFEGGISNMNYSVSDTAEFGGYLSGPRVIDADTKSRMKDILTDIQDGTFTKRLIANVENGNTELEGLRASYNNHPIEETGAKLRDLMSWVKVDARAETA

SEQ ID NO: 10 - protein, 339 aa, Phaeospririlum molischianum
  misc_feature (310)..(310): Xaa can be any naturally occurring amino acid
MRVYYDRDADVNLIKSKKVAVIGYGSQGHAHVLNLRDSGVKDVAVALRPGSASIKKAEAEGLKVLTPAEAAAWADVVMILTPDELQADLYKSELAANLKPGAALVFAHGLAIHFKLIEARADLDVFMVAPKGPGHTVRGEYLKGGGVPCLVAVAQNPTGNALELALSYASAIGGGRSGIIETTFREECETDLFGEQVVLCGGLSKLIQYGFETLVEAGYAPEMAYFECLHEVKLIVDLIYEGGIANMRYSISNTAEYGDYVTGSRIITEATKAEMKRVLADIQSGRFVRDWMLECKAGQPSFKATRRIQXEHVIEVVGEKLRGMMPWISKNKLVDKARN

SEQ ID NO: 11 - protein, 339 aa, Zymomonas mobilis
MKVYYDSDADLGLIKSKKIAILGYGSQGHAHAQNLRDSGVAEVAIALRPDSASVKKAQDAGFKVLTNAEAAKWADILMILAPDEHQAAIYAEDLKDNLRPGSAIAFAHGLNIHFGLIEPRKDIDVFMIAPKGPGHTVRSEYVRGGGVPCLVAVDQDASGNAHDIALAYASGIGGGRSGVIETTFREEVETDLFGEQAVLCGGLTALITAGFETLTEAGYAPEMAFFECMHEMKLIVDLIYEAGIANMRYSISNTAEYGDIVSGPRVINEESKKAMKAILDDIQSGRFVSKFVLDNRAGQPELKAARKRMAAHPIEQVGARLRKMMPWIASNKLVDKARN

SEQ ID NO: 12 - protein, 338 aa, Alkalilimnicola ehrlichei
MQVYYDKDADLSIIQGKKVAVIGYGSQGHAHANNLKESGVDVVVGLREGSSSAAKAQKAGLAVASIEDAAAQADVVMILAPDEHQAVIYHNQIAPNVKPGAAIAFAHGFNIHFGQIQPAADLDVIMVAPKGPGHLVRSTYVEGGGVPSLIAIHQDATGKAKDIALSYASANGGGRAGVIETSFREETETDLFGEQAVLCGGITSLIQAGFETLVEAGYAPEMAYFECLHETKLIVDLLYQGGIANMRYSISNTAEYGDFTRGPRVINEESREAMREILAEIQEGEFAREFVLENQAGCPTLTARRRLAAEHEIEVVGERLRGMMPWINANKLVDKDKN

SEQ ID NO: 13 - protein, 340 aa, Campylobacter lari
MAVSIYYDKDCDINLIKSKKVAIIGFGSQGHAHAMNLRDSGVEVIIGLKEGGQSWAKAQKANFIVKSVKEATKEADLIMILAPDEIQSEIFNEEIKPELKAGKTLAFAHGFNIHYGQIVAPKGIDVIMIAPKAPGHTVRHEFSIGGGTPCLIAIHQDESKNAKNLALSYASAIGGGRTGIIETTFKAETETDLFGEQAVLCGGLSALIQAGFETLVEAGYEPEMAYFECLHEMKLIVDLIYQGGIADMRYSVSNTAEYGDYITGPKIITKETKEAMKGVLKDIQNGSFAKDFILERRANFARMHAERKLMNDSLIEKTGRELRAMMPWISAKKLVDKDKN

SEQ ID NO: 14 - protein, 338 aa, Marinobacter aquaeolei
MQVYYDKDCDLSIIQGKKVAILGFGSQGHAHACNLKDSGVDVVVGLRAGSSSIAKAEAYGLKTSDVASAVASADVVMVLTPDEFQAQLYREEIEPNLKQGATLAFAHGFAIHYNQIVPRKDLDVIMVAPKAPGHTVRTEFTKGGGIPDLIAIFQDASGNAKNVALSYASGIGGGRTGIIETTFKDETETDLFGEQAVLCGGAVELVKAGFETLTEAGYAPEMAYFECLHELKLIVDLMYEGGIANMNYSISNNAEYGEYVTGPEVINEQSREAMRNALKRIQSGEYAKMFISEGALNYPSMTARRRQNAAHEIETVGEKLRSMMPWISANKIVDKDKN

SEQ ID NO: 15 - protein, 338 aa, Psychrobacter arcticus
MNVYYDKDCDLSIVQGKKVAIIGYGSQGHAHALNLQDSNVDVTVGLRADSGSWKKAENAGLKVAEVEEAVKAADIIMILTPDEFQKELYNDVIEPNIKQGATLAFAHGFAIHYNQVIPRSDLDVIMVAPKAPGHTVRSEFAKGGGIPDLIAIYQDASGQAKQLALSYAAGVGGGRSGIIETTFKDETETDLFGEQAVLCGGAVELVKMGFETLTEAGYAPEMAYFECLHELKLIVDLMYEGGIADMNYSISNNAEYGEYVTGPEVINEQSREAMRNALKRIQSGEYAKMFISEGATNYPSMTARRRNNAEHQIEITGAKLRGMMPWIGGNKIIDKDKN

SEQ ID NO: 16 - protein, 338 aa, Hahella chejuensis
MQVYYDKDCDLSIIQGKKVAIIGYGSQGHAHANNLKDSGVDVCVGLRKGSGSWAKAENAGLAVKEVAEAVAGADVVMILTPDEFQAQLYKSEIEPNLKSGATLAFAHGFSIHYNQIVPRADLDVIMIAPKAPGHTVRSEFVKGGGIPDLIAIFQDASGSAKDLALSYASGVGGGRTGIIETTFKDETETDLFGEQAVLCGGAVELVKAGFETLVEAGYAPEMAYFECLHELKLIVDLMYEGGIANMNYSISNNAEYGEYVTGPEVINDQSRAAMRNALKRIQDGEYAKMFIAEGAHNYPSMTAYRRNNAAHPIEQVGEKLRSMMPWIASNKIVDKSKN

SEQ ID NO: 17 - protein, 338 aa, Thiobacillus denitrificans
MKVYYDKDADLSLIKQRKVAIVGYGSQGHAHANNLKDSGVDVTVALRPGSASAKKAENAGLTVKSVPEAVAGADLVMILTPDEFQSRLYRDEIEPNIKQGATLAFAHGFSIHYNQVVPRADLDVIMIAPKAPGHTVRSEFVKGGGIPDLIAIYQDASGKAKETALSYASAIGGGRTGIIETTFKDETETDLFGEQAVLCGGAVELVKAGFDTLVEAGYAPEMAYFECLHELKLIVDLMYEGGIANMNYSISNNAEYGEYVTGVKVINEQSRAAMKECLANIQNGAYAKRFILEGQANYPEMTAWRRNNAAHQIEVVGAKLRSMMPWIAANKLVDHSKN

SEQ ID NO: 18 - protein, 338 aa, Azotobacter vinelandii
MKVYYDKDCDLSIIQSKKVAIIGYGSQGHAHACNLKDSGVDVYVGLRAGSASVAKAEAHGLTVKSVKDAVAAADVVMILTPDEFQGRLYKDEIEPNLKKGATLAFAHGFSIHYNQVVPRADLDVIMIAPKAPGHTVRSEFVRGGGIPDLIAVYQDASGNAKNLALSYACGVGGGRTGIIETTFKDETETDLFGEQAVLCGGCVELVKAGFETLVEAGYAPEMAYFECLHELKLIVDLMFEGGIANMNYSISNNAEYGEYVTGPEVINEQSRQAMRNALKRIQDGEYAKMFITEGAANYPSMTAYRRNNAAHQIEVVGEKLRTMMPWIAANKIVDKTKN

SEQ ID NO: 19 - protein, 338 aa, Pseudomonas syringae
MKVFYDKDCDLSIIQGKKVAIIGYGSQGHAQACNLKDSGVDVTVGLRKGSATVAKAEAHGLKVTDVASAVAAADLVMILTPDEFQSQLYKNEVEPNLKKGATLAFSHGFAIHYNQVVPRADLDVIMIAPKAPGHTVRTEFVKGGGIPDLIAVYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEKLRSMMPWIAANKIVDKDKN

SEQ ID NO: 20 - protein, 338 aa, Pseudomonas syringae
MKVFYDKDCDLSIIQGKKVAIIGYGSQGHAQACNLKDSGVDVTVGLRKGSATVAKAEAHGLKVTDVASAVAAADLVMILTPDEFQSQLYKNEVEPNLKKGATLAFSHGFAIHYNQVVPRADLDVIMIAPKAPGHTVRTEFVKGGGIPDLIAVYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFITEGATGYPSMTAKRRNNAEHGIEVIGEKLRSMMPWIAANKIVDKDKN

SEQ ID NO: 21 - protein, 338 aa, Pseudomonas putida
MKVFYDKDCDLSIIQGKKVAIIGYGSQGHAQACNLKDSGVDVTVGLRKGSATVAKAEAHGLKVADVATAVAAADLVMILTPDEFQGALYKNEIEPNIKKGATLAFSHGFSIHYNQVVPRADLDVIMIAPKAPGHTVRSEFVKGGGIPDLIAIYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRKAMRNALKRIQDGEYAKMFISEGATNYPSMTAKRRNNAAHGIEIIGEQLRSMMPWISANKIVDKTKN

SEQ ID NO: 22 - protein, 338 aa, Pseudomonas entomophila
MKVFYDKDCDLSIIQGKKVAIIGYGSQGHAQACNLKDSGVDVTIGLRKGSATVAKAEAHGLKVTDVATAVAAADLVMILTPDEFQGQLYKQEIEPNIKKGATLAFSHGFAIHYNQVVPRADLDVIMIAPKAPGHTVRSEFVKGGGIPDLIAIYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRKAMRNALKRIQDGEYAKMFISEGATNYPSMTAKRRNNAAHGIEIIGEQLRSMMPWISANKIVDKTKN

SEQ ID NO: 23 - protein, 338 aa, Pseudomonas mendocina
MKVYYDKDCDLSIIQGKKVAIIGYGSQGHAQACNLKDSGVDVTIGLRKGSATVAKAEAHGLKVTDVASAVAAADLVMILTPDEFQGQLYKNEIEPNIKKGATLAFSHGFAIHYNQVVPRADLDVIMIAPKAPGHTVRTEFVKGGGIPDLIAVYQDASGNAKNVALSYASGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEVIGEQLRAMMPWIAANKIVDKTKN

SEQ ID NO: 24 - protein, 336 aa, Bacillus cereus
MAKVYYEKDVTVNVLKEKKVAIIGYGSQGHAHAQNLRDNGFDVVVGLRKGKSWDKAKEDGFSVYTVAEAAKQADVVMILLPDELQPEVYEAEIAPNLQAGNSLVFAHGFNVHFDQVKPPANVDVFLVAPKGPGHLVRRTFSEGGAVPALFAVYQDATGVATEKALSYADGIGATRAGVLETTFKEETETDLFGEQAVLCGGVTALVKAGFETLVDAGYQPELAYFECLHELKLIVDLMYEGGLENMRYSVSDTAQWGDFVSGPRVVTEDTKKAMGTVLAEIQDGTFARGWIAEHKAGRPNFHATNEKENEHEIEVVGRKLREMMPFVQPRVKVGMK

SEQ ID NO: 25 - protein, 335 aa, Bacillus cereus
MKTYYEKDANVELLKGKTVAVIGYGSQGHAQAQNLRDSGVEVVVGVRPGKSFEVAKTDGFEVMSVSEAVRTAQVVQMLLPDEQQAHVYKAGVEENLREGQMLLFSHGFNIHFGQINPPSYVDVAMVAPKSPGHLVRRVFQEGNGVPALVAVHQDATGTALHVALAYAKGVGCTRAGVIETTFQEETETDLFGEQTVLCGGVTALVKAGFETLTEGGYRPEIAYFECLHELKLIVDLMYEGGLTNMRHSISDTAEFGDYVTGSRIVTDETKKEMKRVLTEIQQGEFAKKWILENQAGRPTYNAMKKAEQNHQLEKVGAELREMMSWIDAPKELVKK

SEQ ID NO: 26 - DNA, 1032 bp, Anaerostipes caccae
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggttctaagtcctggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 27 - protein, 343 aa, Anaerostipes caccae
MEECKMAKIYYQEDCNLSLLDGKTIAVIGYGSQGHAHALNAKESGCNVIIGLYEGSKSWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 28 - DNA, 1029 bp, Artificial sequence
  Anaerostipes caccae KARI-AB1D1 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcgaagtcctggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 29 - protein, 343 aa, Artificial sequence
  Anaerostipes caccae KARI-AB1D1 variant
MEECKMAKIYYQEDCNLSLLDGKTIAVIGYGSQGHAHALNAKESGCNVIIGLYEGAKSWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 30 - DNA, 1029 bp, Artificial sequence
  Anaerostipes caccae KARI-495B5 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaagcattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 31 - protein, 343 aa, Artificial sequence
  Anaerostipes caccae KARI 495B5 variant
MEECKMAKIYYQEDCNLSLLDGKTIAVIGYGSQGHAHALNAKESGCNVIIGLYEGAKHWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 32 - DNA, 1029 bp, Artificial sequence
  Anaerostipes caccae KARI-AB1D3 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 33 - protein, 343 aa, Artificial sequence
  Anaerostipes caccae KARI-AB1D3 variant
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 34 - DNA, 1029 bp, Artificial sequence
  Anaerostipes caccae KARI-AB1G9 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcgaaggagtggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 35 - protein, 343 aa, Artificial sequence
  Anaerostipes caccae KARI AB1G9 variant
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 36 - DNA, 1029 bp, Artificial sequence
  Anaerostipes caccae KARI-variant AO7B5
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgcctgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 37 - protein, 343 aa, Artificial sequence
  Anaerostipes caccae KARI AO7B5 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 38 - DNA, 1029 bp, Artificial sequence
  Anaerostipes caccae KARI-AO7A9 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgacgcctgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 39 - protein, 343 aa, Artificial sequence
  Anaerostipes caccae KARI AO7A9 variant
MEECKMAKIYYQEDCNLSLLDGKTIAVIGYGSQGHAHALNAKESGCNVIIGLYEGAKDWKRAEEQGFEVYTAAEAAKKADIIMILTPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 40 - DNA, 1029 bp, Artificial sequence
  Anaerostipes caccae KARI-AO7H8 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatccccgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 41 - protein, 343 aa, Artificial sequence
  Anaerostipes caccae KARI AO7H8 variant
MEECKMAKIYYQEDCNLSLLDGKTIAVIGYGSQGHAHALNAKESGCNVIIGLYEGAKDWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 42 - DNA, 1029 bp, Artificial sequence
  Anaerostipes caccae KARI-AO7D8 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtctgtatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagatcggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 43 - protein, 343 aa, Artificial sequence
  Anaerostipes caccae KARI AO7D8 variant
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVCMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 44 - DNA, 1029 bp, Artificial sequence
  Anaerostipes caccae KARI- AO7F7 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcgttatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagagctgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 45 - protein, 343 aa, Artificial sequence
  Anaerostipes caccae KARI AO7F7 variant
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVVMIAPKGPGHTVRSEYEEGKGVPCLVAVEQDATGKALDMALAYALAIGGARAGVLETTFRAETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 46 - DNA, 1029 bp, Artificial sequence
  Anaerostipes caccae KARI-AO7H7 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaagtgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 47 - protein, 343 aa, Artificial sequence
  Anaerostipes caccae-KARI A07H7 variant
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 48 - DNA, 1029 bp, Artificial sequence
  Anaerostipes caccae AS6F1 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 49 - protein, 343 aa, Artificial sequence
  Anaerostipes caccae KARI-AS6F1 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 50 - DNA, 1029 bp, Artificial sequence
  Anaerostipes caccae AWG4 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 51 - protein, 343 aa, Artificial sequence
  Anaerostipes caccae KARI AW4G variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 52 - DNA, 1029 bp, Artificial sequence
  Anaerostipes caccae AWB9 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcgcaatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 53 - protein, 343 aa, Artificial sequence
  Anaerostipes caccae KARI AWB9 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVAMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 54 - DNA, 1029 bp, Artificial sequence
  Anaerostipes caccae KARI AWC1 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcgttatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 55 - protein, 343 aa, Artificial sequence
  Anaerostipes caccae KARI AWC1 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVVMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 56 - DNA, 1029 bp, Artificial sequence
  Anaerostipes caccae KARI AWF4 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtagcatgttgatgttcgctcacggtttcaacatccatttcggttgtattgttccaccaaaggacgttgatgtcgttatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 57 - protein, 343 aa, Artificial sequence
  Anaerostipes caccae KARI AWF4 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGSMLMFAHGFNIHFGCIVPPKDVDVVMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 58 - DNA, 1029 bp, Artificial sequence
  Anaerostipes caccae KARI AWF6 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcgttatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagagacgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 59 - protein, 343 aa, Artificial sequence
  Anaerostipes caccae KARI AWF6 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVVMIAPKGPGHTVRSEYEEGKGVPCLVAVEQDATGKALDMALAYALAIGGARAGVLETTFRDETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 60 - DNA, 1029 bp, Artificial sequence
  Anaerostipes caccae KARI AWH3 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcgttatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggcgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 61 - protein, 343 aa, Artificial sequence
  Anaerostipes caccae KARI AWH3 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVVMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 62 - DNA, 1029 bp, Artificial sequence
  Anaerostipes caccae KARI AWD6 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcgttatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagatcggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 63 - protein, 343 aa, Artificial sequence
  Anaerostipes caccae KARI AWD6 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVVMIAPKGPGHTVRSEYEEGKGVPCLVAVEQDATGKALDMALAYALAIGGARAGVLETTFRSETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 64 - DNA, 1029 bp, Artificial sequence
  Anaerostipes caccae KARI AWD10 variant
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcgcaatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagatgcgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 65 - protein, 343 aa, Artificial sequence
  Anaerostipes caccae KARI AWD10 variant
MEECKMAKIYYQEDCNLSLLDGKTIAVIGYGSQGHAHALNAKESGCNVIIGLYEGAKDWKRAEEQGFEVYTAAEAAKKADIIMILVPDEKQATMYKNDIEPNLEAGNMLMFAHGFNIHFGCIVPPKDVDVAMIAPKGPGHTVRSEYEEGKGVPCLVAVEQDATGKALDMALAYALAIGGARAGVLETTFRCETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 66 - DNA, 1002 bp, Staphylococcus capitis
atgacaaaagtttattatgatcaatcagttgaaaaagatgctttacaaggtaaaaaaattgcagtaattggttacggttcacaaggacatgcacacgctcaaaatttaaaagacaatggttatgatgtagtcgttggtattcgacctggtcattctttcgatagagctaaagaagatggatttgatgtttatccagtgaatgaggctactaaacaagcagatgtagtaatgattttattacctgatgaaatccaaggtaatgtatataaaaatgaaattgaacctaacttagaagcaggcaatgcattagcttttgcgcacggatttaacattcactttggagttattcaaccccctgctgatgtagatgtattcttagtagcacctaaaggtcctggtcatttagtaagacgtacctttgtagaaggtactgctgtaccagcattattcggtgtacaacaagatgattcaggtcatgcacgtgatatcgcactaagctatgccaaaggtattggtgcaacacgtgctggtgttattgaaactacattcaaagaagaaactgttactgatttattcggtgaacaagctgtactttgcgggggtatccataaattaattcaaagtggttttgaaactttagtagaagctgggtatcaaaaagagttagcatacttcgaagtattacatgaaatgaaattaatcgttgatttaatgtacgaaggcggtatggaaaacgttcgctactctatttcaaatacagctgaatttggtgattatgtatctggaccacgtgttatcactccagaagttaaaaacaacatgaaaactgtattagaagatattcaaaacggtaactttgctaatcgttttgttaaagataatgaaaatggctttaaagaattttaccaattacgtgaacaacaacatggtcatgaaatcgaagcggttggtcgtgaattaagaaaaatgatgccatttattaaagctaaaagtattcaaaaa

SEQ ID NO: 67 - protein, 334 aa, Staphylococcus capitis
MTKVYYDQSVEKDALQGKKIAVIGYGSQGHAHAQNLKDNGYDVVVGIRPGHSFDRAKEDGFDVYPVNEATKQADVVMILLPDEIQGNVYKNEIEPNLEAGNALAFAHGFNIHFGVIQPPADVDVFLVAPKGPGHLVRRTFVEGTAVPALFGVQQDDSGHARDIALSYAKGIGATRAGVIETTFKEETVTDLFGEQAVLCGGIHKLIQSGFETLVEAGYQKELAYFEVLHEMKLIVDLMYEGGMENVRYSISNTAEFGDYVSGPRVITPEVKNNMKTVLEDIQNGNFANRFVKDNENGFKEFYQLREQQHGHEIEAVGRELRKMMPFIKAKSIQK

SEQ ID NO: 68 - DNA, 1002 bp, Staphylococcus epidermidis
atgacaaaagtttattatgatggatctgtaactaaagacgcattacaaggtaaaaaaattgcagtaatcggatatggctcacaaggacatgcccacgcgcaaaacttaaaagatagtggctatgatgtcatcatcggtatccgtcctggacactcatacgataaagctaaaaaagatggtttcgatgtgtatccagtaagtgaagctacaaaacaagcagatgtcgttatggttttattaccagatgaaatccaaggtaacgtatacaaaaatgaaatcgcacctaacttagaagctggtaatgccctagctttcgcccacggttttaacattcactttggtgttattcaacctcctgctgatgtagatgtatttttagtagctcctaaaggaccaggtcaccttgtaagacgtacattcgttgaaggcagtgcagtaccttcattatttggtgttcaacaagatgctactggaaatgcacgtgatatcgctttaagctatgccaaaggtattggtgctacacgtgctggtgttattgaaacaacatttaaagaagaaactgaaactgatttattcggtgagcaagctgtactttgtggtggtatccataaattaattcaaagtggttttgaaactttagtagaagctggttatcaaaaagaattagcttacttcgaagtattacatgaaatgaaattaatcgttgatttaatgtatgaaggcggtatggaaaacgttcgctattctatttcaaatactgccgaatttggtgattatgtatctggaccacgtgtcatcactccagaagttaaaaacaacatgaaaactgtattagaagatatccaaaacggtaactttgctaatcgttttgttaaagataatgaaaatggctttaaagaattctatcaattacgtgaacaacaacatggtcatgaaattgaagcggtaggtcgtgagcttcgtgaaatgatgccatttattaaatctaaaagcattgaaaaa

SEQ ID NO: 69 - protein, 334 aa, Staphylococcus epidermidis
MTKVYYDGSVTKDALQGKKIAVIGYGSQGHAHAQNLKDSGYDVIIGIRPGHSYDKAKKDGFDVYPVSEATKQADVVMVLLPDEIQGNVYKNEIAPNLEAGNALAFAHGFNIHFGVIQPPADVDVFLVAPKGPGHLVRRTFVEGSAVPSLFGVQQDATGNARDIALSYAKGIGATRAGVIETTFKEETETDLFGEQAVLCGGIHKLIQSGFETLVEAGYQKELAYFEVLHEMKLIVDLMYEGGMENVRYSISNTAEFGDYVSGPRVITPEVKNNMKTVLEDIQNGNFANRFVKDNENGFKEFYQLREQQHGHEIEAVGRELREMMPFIKSKSIEK

SEQ ID NO: 70 - DNA, 1002 bp, Staphylococcus aureus
atgacaacagtttattatgatcaagacgtaaaaacggacgctttacaaggcaaaaaaattgcagtagtaggttatggatcacaaggccacgcgcatgcacaaaacttaaaagacaatggatatgatgtagtcatcggtattcgcccaggtcgttcttttgacaaggctaaagaagatggatttgatgtgttccctgttgcagaagcagttaagcaagctgatgtaattatggtgctattacctgatgaaattcaaggtgatgtatacaaaaacgaaattgaaccaaatttagaaaaacataatgtgcttgcatttgctcatggctttaacattcattttggtgttattcaaccaccagctgatgttgatgtatttttagtagctcctaaaggaccgggtcatttagttagacgtacatttgttgaaggttctgctgtaccatcactatttggtattcaacaagacgcttcaggtcaagcacgtaatattgctttaagttatgcaaaaggtattggtgcaactcgtgcaggtgttattgaaacaacatttaaagaagaaactgagacagatttatttggtgaacaagcagtactttgcggtggtgtatcgaaattaattcaaagtggctttgaaacattagtagaagcgggttatcaaccagaattagcttattttgaagtattacatgaaatgaaattaatcgttgatttgatgtatgaaggcggtatggaaaatgtacgttactcaatttcaaatactgctgaatttggtgactatgtttcaggaccacgtgttatcacaccagatgttaaagaaaatatgaaagctgtattaactgatatccaaaatggtaacttcagtaatcgctttatcgaagacaataaaaatggattcaaagaattttataaattacgcgaagaacaacatggtcatcaaattgaaaaagttggtcgtgaattacgcgaaatgatgccttttattaaatctaaaagcattgaaaaa

SEQ ID NO: 71 - protein, 334 aa, Staphylococcus aureus
MTTVYYDQDVKTDALQGKKIAVVGYGSQGHAHAQNLKDNGYDVVIGIRPGRSFDKAKEDGFDVFPVAEAVKQADVIMVLLPDEIQGDVYKNEIEPNLEKHNVLAFAHGFNIHFGVIQPPADVDVFLVAPKGPGHLVRRTFVEGSAVPSLFGIQQDASGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRVITPDVKENMKAVLTDIQNGNFSNRFIEDNKNGFKEFYKLREEQHGHQIEKVGRELREMMPFIKSKSIEK

SEQ ID NO: 72 - DNA, 1002 bp, Staphylococcus warneri
atgacaacagtttattatgatgaatcagtaaaaacagacgctttagaaggtaaaaaaattgctgtgattggatatggttcacaaggccatgctcacgcacaaaacttaaaagataacggatatgatgttgttatcggtatccgtccaggacgctcttttgataaagctaaggaaaatggtttcgatgtatatcctgtggcagaagcaacgaaacaagctgacgttatcatggttttaattccagatgaaatccaaggtgatgtatataaaaatgaaattgaacctaatttagaagctggtaacgcacttgcatttgctcatggtttcaatattcactttggtgttattcaaccccctgcagatgtcgatgttttcttagttgcaccaaaaggaccaggtcacttagttagacgtacatttgaagaaggtagtgcagtgccatctttatttggtgttcaacaagatgctacaggtcatgcaagagatattgcattaagttatgcaaaaggtatcggatctacaagagctggtgtaattgaaacaacatttaaagaagaaacagaaacggatttatttggtgaacaagctgtactatgtggcggtatccataaattaattcaaagtggatttgaaacattagttgaagctggttaccaaccagaattagcctattttgaagtattacatgaaatgaaattaatcgttgatttaatgtatgaaggcggtatggataatgtccgttattcaatttctaatactgcagagtatggtgactatgtatctggacgtcgtatcatcactccagatgtcaaagacaatatgaaagctgtattaacagatattcaaaacggtaaatttgctaatagttttgttgaagataataaaaatggatttaaagaattctataaaatgcgtgaagaacaagctggtcatccaattgaaaaagtgggccgtaaattacgtgatatgatgccatttattaaatcaaaaagcattgaaaag

SEQ ID NO: 73 - protein, 334 aa, Staphylococcus warneri
MTTVYYDESVKTDALEGKKIAVIGYGSQGHAHAQNLKDNGYDVVIGIRPGRSFDKAKENGFDVYPVAEATKQADVIMVLIPDEIQGDVYKNEIEPNLEAGNALAFAHGFNIHFGVIQPPADVDVFLVAPKGPGHLVRRTFEEGSAVPSLFGVQQDATGHARDIALSYAKGIGSTRAGVIETTFKEETETDLFGEQAVLCGGIHKLIQSGFETLVEAGYQPELAYFEVLHEMKLIVDLMYEGGMDNVRYSISNTAEYGDYVSGRRIITPDVKDNMKAVLTDIQNGKFANSFVEDNKNGFKEFYKMREEQAGHPIEKVGRKLRDMMPFIKSKSIEK

SEQ ID NO: 74 - DNA, 1002 bp, Staphylococcus epidermidis
atgacaaaagtatattacgatgaaacagtaactcaagatgcattacaaggtaaaaaaattgctgtcattggttatggctcacaaggacatgcacatgcacaaaatttaaaggacaatggttatgatgtagtcattggtctacgtccaggacgatcatttaataaagctaaagaagatggatttgatgtttatacggtaagtgatgctacacaacaagctgatgtagtgatggtactattgcctgatgaaattcaaggtaaagtatataacgaggaaattaaaccacatttagaaaaaggaaatgctttagcattcgcacacggttttaatatccacttcagtgttatcgaaccacctagtgatgtcgatgtctttttagtagcacctaaaggaccaggtcatttagttagacgtacatttgttgaaggaagtgccgtaccagcattatttggtgttcaacaagatgctacaggccaagcaagaaacattgctttaagctacgcaaaaggcattggtgctactcgtgccggggtcattgaaacgacatttaaagaagaaactgaaacagatttattcggtgaacaagctgttctttgtggaggagtttccaaattaattcagagtggtttcgaaacacttgtagaagcaggttaccaacctgaattagcttattttgaagtcttacacgaaatgaaattaattgttgatttaatgtatgaaggcggaatggaaaacgttcgttattctatctctaacactgctgaatttggcgactatgtttctggaccaagagtaattacacctgatgttaaagaaaatatgaaaaaagtacttgaagatattcaaaatggtaactttagccgtagatttgttgaagataacaaaaatggctttaaagaattctatcaattacgtgaagatcaacatggtcatcaaattgaacaagttggacgtgaattaagagaaatgatgccattcattaaatctaaaagtattgaaaaa

SEQ ID NO: 75 - protein, 334 aa, Staphylococcus epidermidis
MTKVYYDETVTQDALQGKKIAVIGYGSQGHAHAQNLKDNGYDVVIGLRPGRSFNKAKEDGFDVYTVSDATQQADVVMVLLPDEIQGKVYNEEIKPHLEKGNALAFAHGFNIHFSVIEPPSDVDVFLVAPKGPGHLVRRTFVEGSAVPALFGVQQDATGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRVITPDVKENMKKVLEDIQNGNFSRRFVEDNKNGFKEFYQLREDQHGHQIEQVGRELREMMPFIKSKSIEK

SEQ ID NO: 76 - DNA, 1002 bp, Staphylococcus saprophyticus
atgacaacagtttattatgaccaatcagttacgaaagacgctttacaaggtaaaaaagtagcaatcataggctatggttctcaaggacacgcacatgctcaaaatttaaaagacaacggttatgatgtcattatcggaatcagacctggatgttcttttgacaaagctaaagatgatggcttcgaagtatatcctgtagatgaagcagcaaaacaagctgatgtcatcatggtgttattaccagatgaaattcaaggccaagtatataaagaagaaattgaaccaaacttagaagcaaacaatgcattagtattcgcgcatggttttaatattcatttcggtgttattcaaccaccagaaaacgtagatgtattcttagtagcgcctaaaggacctggacatttagtacgtcgtacatttgctgaaggaagcgcagtccctgccctattcgcagttgaacaagatccgagtggtgaagctagagatttagcattaagctatgctaaaggtatcggtgcaacacgtgcaggtgtattagaaacatcatttaaagaagaaacagaaacagatttattcggtgaacaagcagtgctttgtggtggtacgactaaattagtacaatctggtttcgaaacgttagtagaagcaggttaccaaccagaaattgcatactttgaagtattgcatgaaatgaaattgattgttgatttaatgtatgaaggcggtatggaaaatatgcgctattcaatttcaaatacagctgaatttggtgactatgtttctggaccacgtattatcacaccggatgttaaagataatatgaaagctgtattagatgatattcaaaaaggaaacttcagtgatcgattcattaaagataatcaaaataattttgaagaattccataaattaagagaagaacaacatggtcatcaaatcgaagcggttggtagagaactccgtgatatgatgccattcatcaaatctaagagcattgaaaaa

SEQ ID NO: 77 - protein, 334 aa, Staphylococcus saprophyticus
MTTVYYDQSVTKDALQGKKVAIIGYGSQGHAHAQNLKDNGYDVIIGIRPGCSFDKAKDDGFEVYPVDEAAKQADVIMVLLPDEIQGQVYKEEIEPNLEANNALVFAHGFNIHFGVIQPPENVDVFLVAPKGPGHLVRRTFAEGSAVPALFAVEQDPSGEARDLALSYAKGIGATRAGVLETSFKEETETDLFGEQAVLCGGTTKLVQSGFETLVEAGYQPEIAYFEVLHEMKLIVDLMYEGGMENMRYSISNTAEFGDYVSGPRIITPDVKDNMKAVLDDIQKGNFSDRFIKDNQNNFEEFHKLREEQHGHQIEAVGRELRDMMPFIKSKSIEK

SEQ ID NO: 78 - DNA, 1002 bp, Staphylococcus carnosus
atgacaacagtttattatgacgaaacagtaaaagaagatgctttaaaaggtaaaaaaattgcagtagttggttatggttctcaaggccatgctcatgcacaaaacttaaaagacaatggttatgacgttgtaatcggtatccgcccaggtaattctttcgataaagctaaaaaagacggctttgatgtatatccagttgatgaagcagtgaaacaagctgatgtagtaatggtattattacctgatgaaatccaaggtaaagtatatgaagaagaaatcgcaccaaacttagaagctggcaacgctttagcttttgcacatggcttcaacatccactttgatgttatccaaccacctgaagatgttgatgtattcttagttgcccctaaaggaccaggacatttagtaagacgtacatttactgaaggaagctcagtacctgccctattcggtgtagaacaagatgcttctggcaatgctttcaacttagctttaagttatgcaaaaggtatcggagcaacaaaagctggggttatcgaaactacatttaaagaagaaactgaaactgatttatttggtgaacaagctgtactttgcggcggtgtaacaagattaatccaaagtggatttgaaacattagttgaagctggttaccaaccagaattagcttattttgaagtattacatgaaatgaaattaatcgttgatttaatgtatgaaggcggaatggaaacaatgcgttattctatctcaaatacagcagaatacggcgattatgtttctggtccacgtgtcatcactgatgatgttaaacaaaacatgaaagctgtcttagaagatatccaaaacggtaaattcgcaaacagtttcattgaagataataaaaatggtttcaaagagttctacaaattgcgtgaagaagcacaagatcatcaaattcaagaagttggtaaagaacttcgtgaaatgatgccttttgttgaaaataaaactattgaaaaa

SEQ ID NO: 79 - protein, 334 aa, Staphylococcus carnosus
MTTVYYDETVKEDALKGKKIAVVGYGSQGHAHAQNLKDNGYDVVIGIRPGNSFDKAKKDGFDVYPVDEAVKQADVVMVLLPDEIQGKVYEEEIAPNLEAGNALAFAHGFNIHFDVIQPPEDVDVFLVAPKGPGHLVRRTFTEGSSVPALFGVEQDASGNAFNLALSYAKGIGATKAGVIETTFKEETETDLFGEQAVLCGGVTRLIQSGFETLVEAGYQPELAYFEVLHEMKLIVDLMYEGGMETMRYSISNTAEYGDYVSGPRVITDDVKQNMKAVLEDIQNGKFANSFIEDNKNGFKEFYKLREEAQDHQIQEVGKELREMMPFVENKTIEK

SEQ ID NO: 80 - DNA, 993 bp, Listeria monocytogenes
atgacaaaagtttattatgaagatgcagtaaaaaacaacgcactagaaggtaaaacagtagcagtaatcgggtacggttcgcaaggtcacgcacattctcaaaatctacgtgacaatggcaataacgttattatcggcattcgcgaaggaaaatctgccgaatctgctagaaacgatggctttgatgtttattctgttagcgaagccgctgataaagctgatgtcatcatgattcttttgccagatgaaacacaaggcgaaacatacgaaaatgaaattaaacctaacctaaaagctggtaattcacttgttttcgctcacggttttaacattcattttgacgtaattaatcctccaagcgatgtagatgtttttctagtagctccaaaaggtcctggtcacttagttcgccgcacatttgttgaaggtggcgctgttccttccctattcgctatctatcaagatgccactggaaacgcacgcgacacagccctttcctatgcaaaaggtattggcgcaactcgtgctggcgttatcgaaaccactttcaaagaagaaaccgaaaccgatctatttggcgaacaagcagttctttgtgggggtgcgactcaccttatccaagctggtttcgaaacacttgtagaggctggctaccaaccagaacttgcttattttgaagtattacatgaaatgaaactaattgttgatttgatgtatgaaggtggtatggaaaaaatgcgccactcgatctccaatacagcagaatatggtgattatgtttccggtcctcgagttgttacagccgatacgaaaaaagcaatgaaagaagtacttaccgacattcaaaatggtaactttgctaaatctttcatcaatgacaacaaaaatggttttaaagaattccatagaatgcgtaaagaacaacaaggtcatcaaatcgaaaaagttggtgcagaacttcgcgaaatgatgccatttgtcaaaccacaacat

SEQ ID NO: 81 - protein, 331 aa, Listeria monocytogenes
MTKVYYEDAVKNNALEGKTVAVIGYGSQGHAHSQNLRDNGNNVIIGIREGKSAESARNDGFDVYSVSEAADKADVIMILLPDETQGETYENEIKPNLKAGNSLVFAHGFNIHFDVINPPSDVDVFLVAPKGPGHLVRRTFVEGGAVPSLFAIYQDATGNARDTALSYAKGIGATRAGVIETTFKEETETDLFGEQAVLCGGATHLIQAGFETLVEAGYQPELAYFEVLHEMKLIVDLMYEGGMEKMRHSISNTAEYGDYVSGPRVVTADTKKAMKEVLTDIQNGNFAKSFINDNKNGFKEFHRMRKEQQGHQIEKVGAELREMMPFVKPQH

SEQ ID NO: 82 - DNA, 993 bp, Listeria grayi
atgacaaaagtatattatgaagatgctgtaaaagaaaatgcactaacggggaagaaagttgccgttatcggttatggatcacaaggacatgcgcattcgcaaaatctgcgtgacaatggcaatgacgttatcatcggtatccgcgaaggacgttctaaagaaagtgcgaaaaacgacggcttcgatgtttactccgttgccgaagcgagtaaacaagcagatgtcatcatgatccttctaccagacgaaatccaaggagatacatacgaaaaagaaatcagcccaaacttggaagcaggaaatgccattgttttcgcccatggtttcaacatccattttgatgtgatcaaacctcctacagatgtagatgttttcctagttgcaccaaaaggccccggacatctagtaagacgtacctttgtagaaggcggtgccgtcccttccctcttcgccgtccaccaagatgccactggcaaagcgcaggacctcgccctttcttatgccaaaggaatcggagctacacgtgccggcgttatcgaaacaactttcaaagaagaaacagaaacggatctattcggtgaacaagctgtcctatgcggcggtgccactcaccttatccaagcaggctttgaaacacttgtagaagcaggctatcaaccggaactcgcttacttcgaagtactgcatgagatgaaactgatcgtagacctgatgtacgaaggcggaatggaaaaaatgcgctattcgatctccaatacagcagaatatggcgactatgtatccggtccgcgcatcgtgaccagcgatacgaagaaagcgatgaaagaagtattgaccgatatccaaaatggtaattttgccaaatcgtttatcgatgacaataaaaacggcttcaaagaatttcaccgaatgcgcaaagaacagcaaggtcatcaaatcgaagcagtcggcaaaaatctccgcgaaatgatgccgttcgtaaatccaagaaaa

SEQ ID NO: 83 - protein, 331 aa, Listeria grayi
MTKVYYEDAVKENALTGKKVAVIGYGSQGHAHSQNLRDNGNDVIIGIREGRSKESAKNDGFDVYSVAEASKQADVIMILLPDEIQGDTYEKEISPNLEAGNAIVFAHGFNIHFDVIKPPTDVDVFLVAPKGPGHLVRRTFVEGGAVPSLFAVHQDATGKAQDLALSYAKGIGATRAGVIETTFKEETETDLFGEQAVLCGGATHLIQAGFETLVEAGYQPELAYFEVLHEMKLIVDLMYEGGMEKMRYSISNTAEYGDYVSGPRIVTSDTKKAMKEVLTDIQNGNFAKSFIDDNKNGFKEFHRMRKEQQGHQIEAVGKNLREMMPFVNPRK

SEQ ID NO: 84 - DNA, 987 bp, Enterococcus casseliflavus
atggtaaaagtatattacaacgaggaagttacagataatttaggagacaagaagattgcgatcgtcggctacggctctcaagggcacgctcatgcgcaaaatttacgggacacaggtcatgaagtctttatcggcattcgtgaaggaaaatcagcggaagccgcaagaaacgatggatttgaggttttcccagtagctgaagccgttcaaaaagcggatgtagtcatgatcttggcacccgatgagatccaaggatcgttgtataaaaatgagatcgaaccgaatctttctgcgggcaatgcattggcatttgctcatggtttcaatattcattttgatgtgatcgcgccaccaaaagaggtggatgtttttctagttgcgccaaaaggaccaggtcatttggtgcgtcgaacctttaccgaagggtttgcggtaccagccttgtttgcagtttatcaagatgcgactggtaacgcacaagcaacggctttatcctatgcaaaaggcattggtgccacacgggtcggcgttttggaaacgacctttaaagaagagaccgaaaccgatcttttcggtgagcaagccgtactttgtggcggtttgaccagtatgatcgaagcgggctttgaaacattggtagaagcggggtaccaaccggaattggcttattttgaagtttgtcatgaattgaaactgatcgttgatttgatttatgaaggaggcttcaaaaaaatgcgccattcgatctcgaatacggctgagtatggtgactacgtttctggtgctcgggtgatcactgcacaagccaaagaaaacatgaaagccgtattgacagacatccaaaacggccaatttgcgaaaggattcattgaagacaatcaaaacggcttccctgaattccataaaatgcgtgaggaaaacggcaatcatcaaattgaaaaagtcggcagcgagttacggaaaatgatgccgtttgttgcgaaagat

SEQ ID NO: 85 - protein, 329 aa, Enterococcus casseliflavus
MVKVYYNEEVTDNLGDKKIAIVGYGSQGHAHAQNLRDTGHEVFIGIREGKSAEAARNDGFEVFPVAEAVQKADVVMILAPDEIQGSLYKNEIEPNLSAGNALAFAHGFNIHFDVIAPPKEVDVFLVAPKGPGHLVRRTFTEGFAVPALFAVYQDATGNAQATALSYAKGIGATRVGVLETTFKEETETDLFGEQAVLCGGLTSMIEAGFETLVEAGYQPELAYFEVCHELKLIVDLIYEGGFKKMRHSISNTAEYGDYVSGARVITAQAKENMKAVLTDIQNGQFAKGFIEDNQNGFPEFHKMREENGNHQIEKVGSELRKMMPFVAKD

SEQ ID NO: 86 - DNA, 984 bp, Enterococcus gallinarum
atggtaaaagtatattataacgaagtgacagacaatttaggagataagactattgcaatcattggttacggttctcaaggacatgcccatgcacagaatttacgggatacaggacacaacgtcgtgatcgggattcgtgcaggaaaatcagctgagaacgcaaagaatgatggatttaccgtgcttccagtttctgaagctgtacaacaagcaaatgttgtgatgatcttagctcctgatgagatccaaggagaactttacgagaaggaaattgcgcctaatctttctgcaggggatgcattagcctttgctcatggctttaatattcattttgaggtcatcacgcctccaaaagaggtggatgtcttcctggtggcacctaaaggaccaggccatttggtgcgccggacctttagcgaaggatttgctgtccctgcgttgtttgctgtttatcaagatgctactggcaatgcacaagagacagccttgtcctatgccaaaggaatcggggctacaagagtcggtgtactagaaacaacgttcaaggaagagacggaaacagacttgtttggggaacaagccgtattatgtggcggactgacaagtatgatcgagactgggtttgaaacgctggtagaagccggctatcagccagaactagcctattttgaagtttgtcacgaaatgaaactgattgttgacttgatttatgaaggaggattcgccaagatgcgtgattcaatctccaatacagcagaatatggggattatgtctctggttcacgaatcattaccgaacaaacaaaagccaatatgaagaatgtcttgaaagatattcaaaacggcacgtttgccaaaggttttattgcggataatcaagctggttttccggaattcaaaaaaatgcgggaacaaaacgggaatcatccaatcgaaaaagttgggtcagaattaagaaaaatgatgccttttgttacgaaagat

SEQ ID NO: 87 - protein, 328 aa, Enterococcus gallinarum
MVKVYYNEVTDNLGDKTIAIIGYGSQGHAHAQNLRDTGHNVVIGIRAGKSAENAKNDGFTVLPVSEAVQQANVVMILAPDEIQGELYEKEIAPNLSAGDALAFAHGFNIHFEVITPPKEVDVFLVAPKGPGHLVRRTFSEGFAVPALFAVYQDATGNAQETALSYAKGIGATRVGVLETTFKEETETDLFGEQAVLCGGLTSMIETGFETLVEAGYQPELAYFEVCHEMKLIVDLIYEGGFAKMRDSISNTAEYGDYVSGSRIITEQTKANMKNVLKDIQNGTFAKGFIADNQAGFPEFKKMREQNGNHPIEKVGSELRKMMPFVTKD

SEQ ID NO: 88 - DNA, 990 bp, Macrococcus caseolyticus
atggctaaagtatattatgataacgatgtaaataaggaatacttaaaaaataagaaaattgcagtattagggtacggctctcaaggacacgcgcatgcattgaatcttaaggacagtggctatgacgtagtcatcggagtacgtgaagggcagtccagaacaaaggcagaagaagatggatttcaagcatatgacgtcagtgaagctgtggaacgtgcggatgttaccgtcgtccttatgccggacgaagtacagcagcgtgtgttcaacgaggaaatcgtacctcatctcaaaccacaatcggctctagttttcgctcatggatttaatgtgcatttcggtgcaataaaagctcctgacgatgttgatgtcttcttagtcgcaccaaaaggaccaggacatcttgttcgacgcgaatatgttaagggcagtgctgtccctgcgttatttgcagtcgatcaggatgtaactggtgatgcaaaggcccttgcactgaactatgcacacggcatcggtgcaacgcgcgccggcgtcatcgaaacgaccttcaaggaagaaacagagacagacctttttggtgagcaagcggtactctgcggcggtatcacaaagctcatccactacggttttgaaacactgacggaagcaggttatcagccagaactcgcctatttcgaagtactgcatgaaatgaagctgattgtggaccttatgtacgagggcggtatggagaagatgagacattccatctcaaataccgctgagtttggagattatgtctctggtgcgcgcgttattacccccgaagttaaggaaaatatgaaacaggtattagctgatatccagtctggcacattcagcaggcagtttatcgaagacaataataatggatttgagtcttttaaatctatgagaagtacccaggcaggacatcctatagagaaagtcggtgcagacctaagaatgatgatgccgtttatcaataataac

SEQ ID NO: 89 - protein, 330 aa, Macrococcus caseolyticus
MAKVYYDNDVNKEYLKNKKIAVLGYGSQGHAHALNLKDSGYDVVIGVREGQSRTKAEEDGFQAYDVSEAVERADVTVVLMPDEVQQRVFNEEIVPHLKPQSALVFAHGFNVHFGAIKAPDDVDVFLVAPKGPGHLVRREYVKGSAVPALFAVDQDVTGDAKALALNYAHGIGATRAGVIETTFKEETETDLFGEQAVLCGGITKLIHYGFETLTEAGYQPELAYFEVLHEMKLIVDLMYEGGMEKMRHSISNTAEFGDYVSGARVITPEVKENMKQVLADIQSGTFSRQFIEDNNNGFESFKSMRSTQAGHPIEKVGADLRMMMPFINNN

SEQ ID NO: 90 - DNA, 1020 bp, Streptococcus vestibularis
atggcagttcaaatggaatatgaaaaagacgtaaaagtagcagcacttgacggtaaaaaaatcgccgttatcggttacggttcacaaggtcatgcacatgcacaaaacttgcgtgattcaggtcacgatgtgatcatcggtgttcgtccaggtaaatcatttgataaagctaaagaagatggttttgatacttacacagtagcagaagcaactaaattggctgatatcattatggttttggcaccagatgaaattcaaaaagatatctataaagatgaaattgagccaaacttgagtgcaggcaaagctcttggttttgcacacggatttaacatccacttcgaattcatcaaggttcctaaagatgttgatgtctttatggttgctcctaaaggaccaggtcacttggtacgccgtacatatacagaaggctttggtgttccagcactttacgcagtataccaagatgctacaggcaatgctaaagacatcgctatggactgggctaaaggtattggttctgcacgtgttggattacttgtaacaacatttaaagaagaaactgaagaagatttgtttggtgagcaagcggttcttatgggtgggttgacacatcttattgaagctggttttgaagtcttgactgaagcaggctatgcaccacaattggcttactttgaagtgcttcacgaaatgaaattgatcgttgacttgatctacgaaggtggattcaagaaaatgcgtcaatcatgttcaaatactgcagaatttggtgactttgtaactggtccacgtgtcatcggtccagaagtcaaagaaaacatgaaagctgcccttgcggatatccaatcaggtaaatttgcacgtgaattcgttgaagaccatgatgctggcttcccacgtttgaaagcttaccgtaaagaagctgaagagcttgaaattgaaaagattggtgctgaattgcgtaaagcaatgccattcgttggtcaaaatgacgatgacgcattcaaaatctataac

SEQ ID NO: 91 - protein, 340 aa, Streptococcus vestibularis
MAVQMEYEKDVKVAALDGKKIAVIGYGSQGHAHAQNLRDSGHDVIIGVRPGKSFDKAKEDGFDTYTVAEATKLADIIMVLAPDEIQKDIYKDEIEPNLSAGKALGFAHGFNIHFEFIKVPKDVDVFMVAPKGPGHLVRRTYTEGFGVPALYAVYQDATGNAKDIAMDWAKGIGSARVGLLVTTFKEETEEDLFGEQAVLMGGLTHLIEAGFEVLTEAGYAPQLAYFEVLHEMKLIVDLIYEGGFKKMRQSCSNTAEFGDFVTGPRVIGPEVKENMKAALADIQSGKFAREFVEDHDAGFPRLKAYRKEAEELEIEKIGAELRKAMPFVGQNDDDAFKIYN

SEQ ID NO: 92 - DNA, 1020 bp, Streptococcus mutans
atggcagtagaaatgttatatgaagcagatgtaaaagtagcagcacttgatggtaagaagattgctgttattggttatggatcacaaggacatgctcatgcccaaaacttgagagattcaggacacgatgttatcatcggtgtgcgtcatgggaaatcgtttgacaaggctaaagaagatggttttgatacctatgaagtgggtgaagctactaaattggctgatattatcatggttttagcaccggatgaaattcaaaaagatatctacaaagatgaaattgctcctaatttaagtgctggtaaggctcttggttttgctcatggttttaatatccatttcggttatattaaggcaccagaagatgtagatgttttcatggttgcccctaaaggaccgggccatcttgtacgtcgtacttacacagaaggatttggagtaccttctttatatgctgtttatcaaaatccaactggtaatgctgaaaatattgctttagattgggctaagggtattggttctgcgcgtgtaggtctccttgtaaccactttcaaagaagaaacggaagaagacctttttggtgaacaagcggttcttatgggtggtttaactcaccttattgaagcaggttttgaagtgcttactgaagcagggtatgctccacaattggcttattttgaagtgcttcatgaaatgaaattgattgtagaccttatctatgaaggtggtttcaagaaaatgcgtcaatcatgttcaaataccgctgaatttggtgactttgtgacaggcccacgtgttatcggtccagaagtaaaagaaaacatgaaggctgctcttgctgatattcaatcaggtaaatttgcccgtgaattcgtggaagatcatgatgctggcttcccacgtttgaaagctttccgtaaagaagctgaaggactcgaaatcgaaaaaattggtgcagaacttcgtaaagcaatgccatttgttaatcaaaacgatgacgatgctttcaaaatttataac

SEQ ID NO: 93 - protein, 340 aa, Streptococcus mutans
MAVEMLYEADVKVAALDGKKIAVIGYGSQGHAHAQNLRDSGHDVIIGVRHGKSFDKAKEDGFDTYEVGEATKLADIIMVLAPDEIQKDIYKDEIAPNLSAGKALGFAHGFNIHFGYIKAPEDVDVFMVAPKGPGHLVRRTYTEGFGVPSLYAVYQNPTGNAENIALDWAKGIGSARVGLLVTTFKEETEEDLFGEQAVLMGGLTHLIEAGFEVLTEAGYAPQLAYFEVLHEMKLIVDLIYEGGFKKMRQSCSNTAEFGDFVTGPRVIGPEVKENMKAALADIQSGKFAREFVEDHDAGFPRLKAFRKEAEGLEIEKIGAELRKAMPFVNQNDDDAFKIYN

SEQ ID NO: 94 - DNA, 1020 bp, Streptococcus gordonii
atggcagttcaaatggaatacgaaaaagatgtaaaagtagcagcgcttgacggtaagaaaattgccgtaatcggctatggttcacaaggtcatgctcatgcacaaaatctgcgtgatacaggccatgatgtgattatcggtgttcgccctggtaagtcattcgataaggctaaagaagatggctttgatacttacacagtagcagaggcagctaagttggctgatgtaatcatgattttggcgccagatgaaattcaacaagaactctacgaagcagaaatcgctccaaacttggaagctggtaatgcagttggatttgcccatggtttcaatatccattttgaatttatcaaagttcctgctgatgtagatgtctttatgtgtgcccctaaaggtcctggtcacttggttcgtcgtacttttgaagaaggatttggtgttccggctctttatgcagtctaccaagatgcaacaggaaatgcgaaaaacattgctatggactggtgtaaaggtgttggtgcagctcgtgttggtttgcttgaaacaacttacaaagaagaaacagaagaagatctctttggtgaacaagctgtcctttgtggtggtttgactgcccttatcgaagcaggttttgaagtcttgacagaagcaggttacgctcctgaattggcttactttgaagttcttcatgaaatgaaattgatcgttgacttgatctacgagggtggattcaagaaaatgcgccaatcaatttcaaatactgctgaatatggtgattacgtatcaggcccacgtgtaattactgagcaagtcaaagaaaacatgaaggctgttttggcagacattcaaaatggtaaatttgcaaatgactttgtaaatgactacaaggctggccgtccaaaactcactgcttaccgtgaacaagcagccaaccttgaaatcgaaaaagtaggtgctgaattgcgtaaagcaatgccatttgttggtaaaaatgacgacgacgcatttaaaatctacaac

SEQ ID NO: 95 - protein, 340 aa, Streptococcus gordonii
MAVQMEYEKDVKVAALDGKKIAVIGYGSQGHAHAQNLRDTGHDVIIGVRPGKSFDKAKEDGFDTYTVAEAAKLADVIMILAPDEIQQELYEAEIAPNLEAGNAVGFAHGFNIHFEFIKVPADVDVFMCAPKGPGHLVRRTFEEGFGVPALYAVYQDATGNAKNIAMDWCKGVGAARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVNDYKAGRPKLTAYREQAANLEIEKVGAELRKAMPFVGKNDDDAFKIYN

SEQ ID NO: 96 - DNA, 1020 bp, Streptococcus suis
atgacagtaacaatgcaatatgaaaaagatgtaacagtggcagcacttgacggtaaacgtatcgccgttatcggttatggttcacaaggtcatgcccatgctcaaaacttgcgtgatacaggacacgatgtcatcatcggtgtgcgtgcaggtaagtcatttgacaaggcaaaagaagacggttttgaaacttttgaagtagcagaggcagcaaaacaagctgatgtcattatgattttggctccagacgaaattcaagcagatttgtatgagaacgaagttgctccaaacttggaagctggaaatgcgcttggttttgctcatggtttcaacgttcactttgaatttatcaaggtaccagcagatgtggatgtcttcatgtgtgcaccaaaaggtccaggtcacttggtccgccgtacctttgaagaaggttttggagtaccagccctctatgcggtctaccaagatgcaactggcaatgcaaaacatattgcgatggactgggcaaaaggtgttggttcagcccgtgttggtcttttggaaacaactttcaaagaagagacagaagaagatttgtttggtgagcaagctgttctctgcggtggtttgacagcccttatgcaggcaggttttgaagtcttgacagaagctggttatgcaccagaattggcttatttcgaagttctccacgagatgaaactcatcgttgaccttgtctacgaaggtggctttaagaaaatgcgccaatctatttcaaacactgctgaatttggtgactatgtatcaggtccacgcgtgattacagaccaagtcaaagaaaacatgaaggcagtccttgcagatattcaatctggtaaatttgcaaatgactttgtaaatgactataaagcaggccgtccacgtatggaagcttatcgtaaagaagcagagaatcttgaaatcgaaaaagtaggtgcagaactccgcaaagcaatgccatttgtcggacgcaatgatgacgacgcattcaaaatctataat

SEQ ID NO: 97 - protein, 340 aa, Streptococcus suis
MTVTMQYEKDVTVAALDGKRIAVIGYGSQGHAHAQNLRDTGHDVIIGVRAGKSFDKAKEDGFETFEVAEAAKQADVIMILAPDEIQADLYENEVAPNLEAGNALGFAHGFNVHFEFIKVPADVDVFMCAPKGPGHLVRRTFEEGFGVPALYAVYQDATGNAKHIAMDWAKGVGSARVGLLETTFKEETEEDLFGEQAVLCGGLTALMQAGFEVLTEAGYAPELAYFEVLHEMKLIVDLVYEGGFKKMRQSISNTAEFGDYVSGPRVITDQVKENMKAVLADIQSGKFANDFVNDYKAGRPRMEAYRKEAENLEIEKVGAELRKAMPFVGRNDDDAFKIYN

SEQ ID NO: 98 - DNA, 1020 bp, Streptococcus infantarius
atggcagtaacaatggaatacgaaaaagacgtaaaagtagcagctcttgatggtaaaaaaattgccgttattggttatggatcacaaggtcatgctcatgctcaaaacttgcgtgactcaggtcacgatgttatcattggggttcgccatggtaaatcattcgataaagcaaaagaagatggatttgatacttatgaagtagcagaagcaacaaaacttgctgatgttatcatggtattggctcctgatgaaatccaagctaaactttatgctgaagaaatcgctccaaaccttgaagctggtaacgctcttggatttgcacatggttttaatatccgttttggatacattaaagctccagaaacagtagatgtcttcatgtgtgctcctaaaggaccaggtcaccttgttcgtcgtacttacacagaaggatttggtgtaccagcactttacgctgtttaccaagatgctactggtaatgctaaagacatcgcaatggattggtctaaaggtatcggtgctgcacgtgttggacttcttgaaacaacatttaaagaagaaactgaagaagacctctttggtgaacaagcagtactttgtggtggtttaactgctcttatcgaagctggttttgaagttcttactgaagctggctatgctccagaattggcttactttgaagttcttcatgaaatgaaacttatcgttgaccttatctacgaaggtggattcaagaaaatgcgtcaatcaatttcaaatacagctgaatttggtgactacgtatctggaccacgtgttatcactaaagatgttaaagaaaatatgaaagctgttcttgctgatatccaatcaggtaaattcgctgaagattttgttaacgactaccaagcaggtcgtccaaaacttgaagcataccgtaaagaagctgcagctcttgaaattgaaaaagtgggtgctgaacttcgtaaagcaatgccttttgttaaccaaaacgatgacgatgcattcaaaatttataac

SEQ ID NO: 99 - protein, 340 aa, Streptococcus infantarius
MAVTMEYEKDVKVAALDGKKIAVIGYGSQGHAHAQNLRDSGHDVIIGVRHGKSFDKAKEDGFDTYEVAEATKLADVIMVLAPDEIQAKLYAEEIAPNLEAGNALGFAHGFNIRFGYIKAPETVDVFMCAPKGPGHLVRRTYTEGFGVPALYAVYQDATGNAKDIAMDWSKGIGAARVGLLETTFKEETEEDLFGEQAVLCGGLTALIEAGFEVLTEAGYAPELAYFEVLHEMKLIVDLIYEGGFKKMRQSISNTAEFGDYVSGPRVITKDVKENMKAVLADIQSGKFAEDFVNDYQAGRPKLEAYRKEAAALEIEKVGAELRKAMPFVNQNDDDAFKIYN

SEQ ID NO: 100 - DNA, 1020 bp, Lactococcus lactis
atggcagttacaatgtattatgaagaagatgtagaagtagccgcactcgcgggtaagaaaatcgcagtgattggatatggctcacaaggacacgctcatgcacaaaacttgcgtgattctggtcatgatgtgattattggtgtccgtcaggggaaatcttttgataaagcaaaagaagatggttttgaaacatttgaagtaggagaagcagtagctaaagctgacgtcattatggttctggcacctgatgaacttcaacaatctatttatgaagaggacataaaaccaaatttgaaagcaggttcagcacttggttttgcccatggtttcaatattcattttggctatattgaagttccagaagatgttgatgtcttcatggttgcgccaaaagcgccgggacatctcgttcggcggacttttaccgaaggtttcggaacgccagctttgttcgtttcgcatcaaaatgccactggtcatgcgcgtgaaattgccatggactgggccaaaggaattggctgtgcccgtgtcggtatcattgaaacaactttcaaagaagaaacagaagaagatttgtttggcgaacaggccgtgctttgtggcggtttgacagcacttgttgaagctggttttgaaacactgacagaagctggatatgctggcgaattggcttactttgaagtgctgcatgaaatgaaattgattgttgaccttatgtacgaaggtggtttcactaaaatgcgtcagtcaatctcaaacactgccgaatttggtgattatgtgactggaccacgcattattactgacgaagttaaaaagaatatgaaactcgtgttggctgacattcaatcaggaaaatttgcgcaagatttcgttgatgatttcaaagctggacgtccaaaattaactgcttatcgtgaagcagctaaaaatctggaaattgaaaaaatcggtgcagaactacgtaaagcaatgccatttacacaatctggtgatgacgacgcctttaaaatttatcaa

SEQ ID NO: 101 - protein, 340 aa, Lactococcus lactis
MAVTMYYEEDVEVAALAGKKIAVIGYGSQGHAHAQNLRDSGHDVIIGVRQGKSFDKAKEDGFETFEVGEAVAKADVIMVLAPDELQQSIYEEDIKPNLKAGSALGFAHGFNIHFGYIEVPEDVDVFMVAPKAPGHLVRRTFTEGFGTPALFVSHQNATGHAREIAMDWAKGIGCARVGIIETTFKEETEEDLFGEQAVLCGGLTALVEAGFETLTEAGYAGELAYFEVLHEMKLIVDLMYEGGFTKMRQSISNTAEFGDYVTGPRIITDEVKKNMKLVLADIQSGKFAQDFVDDFKAGRPKLTAYREAAKNLEIEKIGAELRKAMPFTQSGDDDAFKIYQ

SEQ ID NO: 102 - DNA, 1032 bp, Lactococcus lactis
atggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagcacgtcaagcaatgccattcacacaatctggtgatgacgatgcctttaaaatctatcagtaatttctcttat

SEQ ID NO: 103 - protein, 344 aa, Lactococcus lactis
MAVTMYYEDDVEVSALAGKQIAVIGYGSQGHAHAQNLRDSGHNVIIGVRHGKSFDKAKEDGFETFEVGEAVAKADVIMVLAPDELQQSIYEEDIKPNLKAGSALGFAHGFNIHFGYIKVPEDVDVFMVAPKAPGHLVRRTYTEGFGTPALFVSHQNASGHAREIAMDWAKGIGCARVGIIETTFKEETEEDLFGEQAVLCGGLTALVEAGFETLTEAGYAGELAYFEVLHEMKLIVDLMYEGGFTKMRQSISNTAEFGDYVTGPRIITDEVKKNMKLVLADIQSGKFAQDFVDDFKAGRPKLIAYREAAKNLEIEKIGAEHVKQCHSHNLVMTMPLKSISNFSY

SEQ ID NO: 104 - DNA, 1041 bp, Leuconcstoc mesenteroides
atgactacaaaaatgttttatgataaagatattgatacaacaccattggaaaacaaaaagattgcagttattggctatggtgcacaagggcatgctcaagcgaataatctacgcgactcaggatttgatgtcatcatgggattgcgcccaggaaaatcttttgatagtgctaaaaaagatgggttcgaagtttactcagctgctgaagcaacggcacaagcggatgttgttatgatggaaacccctgacgaattacaagcggcagtttgggagaaagaagttgagcctaaccttaaggcaggttcttaccttggattttctcatgggttcaacattgtttatggtttgattaagcccaatgctgatattaatgtcatgatcattgcgccaaagggtccaggaaacattgaacgtcgccaattcgttgaagggggtgggattccttctttgtatggtgttcatcaagatcctacgggtgatacagctgaagtggccaaggcctatgcgaaaggtattggttcaggtcgcgcaggtatcttggaaacgacttttgaagaagaaacaacagaagacttgtttggtgaacaagctgtactttgtggtggcttaacacaattgattgaggcaggatttaacacattggtggaagcaggttactcacctgaattggcttatttcgaaacatctcatgaaatgaagatgattgttgatttgatctttgaaggtggtttcgagaagatgagacacgattgctcaaatacttgtgaatatggtgaaatgttgaacggaccacgtatcatcactgaagaatcaaagcaaggaatgcgtgatgttttgaaggatatccaagatggtacttatgctaagaagtggttggcagaatacaattctggtttgaaggatttggaaaagatgcggacagagtataagagcggtttgtacgagcaaacaggtaagaaggttcgtgctatgatgccatggatttcagatgcagataagtactcgacagcagcagatactgagcaattctcagcagcaaag

SEQ ID NO: 105 - protein, 347 aa, Leuconostoc mesenteroides
MTTKMFYDKDIDTTPLENKKIAVIGYGAQGHAQANNLRDSGFDVIMGLRPGKSFDSAKKDGFEVYSAAEATAQADVVMMETPDELQAAVWEKEVEPNLKAGSYLGFSHGFNIVYGLIKPNADINVMIIAPKGPGNIERRQFVEGGGIPSLYGVHQDPTGDTAEVAKAYAKGIGSGRAGILETTFEEETTEDLFGEQAVLCGGLTQLIEAGFNTLVEAGYSPELAYFETSHEMKMIVDLIFEGGFEKMRHDCSNTCEYGEMLNGPRIITEESKQGMRDVLKDIQDGTYAKKWLAEYNSGLKDLEKMRTEYKSGLYEQTGKKVRAMMPWISDADKYSTAADTEQFSAAK

SEQ ID NO: 106 - DNA, 1044 bp, Lactobacillus buchneri
atgagtgtagaaatgttgtatgacaaggatgttaccaccaattatcttcaaggaaagaaaattgcttttatcggttatggatcacaaggtcatgcccaagctaacaacttaagagattcaggttatgacgttatcgttggtgttcgcccaggacaatcatttgaaaatgccaaagttgatggatttgatgtatacacaccagccgaagcagctcgtcgtgcagactggattcaaatgttaacgcctgatgaagttatgggcgacgtttataaaaatgaaattgcacctaacctagaggaaggcaatgtattaggcttttcacatggcttcaacattcattataaagaaatcgtaccaccagcaaacgttgatgttgttatgatggcacctaaaggcccaggtaatctttgtcgtcgtacatacgttgaaggctccggtgttccagcattatatggctatttccaagactattcaggtcatgccgaagatttatccaaggaattcgccaaaggaaatggtgcagcacgtgccggactattgaagacaaccttcaaagaagaaactgaagaagatttgtttggtgagcaaaacgtccttatgggtggtgttaccgcgcttatcgaaaccggttatgaagtcttaaccgaagcaggatactcaccacagttggcatacttcgaagtggatcacgaaatgaaattgatctgtgaccttatctacgaaggtgggttcaacaagatgtatgctgactgctcgaacacttctgaatatggttcatatgtagttggtccaaaggtcgttggtaaggaatccaagcaagctatgaaagacgctttgaagcggattcaagacggttcatttgctaaagaattcatggatgactaccgtaacggcttcaagaagctttacaagatgcgtgaacgttcagctaactcacttctttcacgtgttggtgctgatcttcgtgatcacatgtcatttgttggtgaagccgacaagtacagtacacctactgaagaaaaagcagaagcagaagctgaaaag

SEQ ID NO: 107 - protein, 348 aa, Lactobacillus buchneri
MSVEMLYDKDVTTNYLQGKKIAFIGYGSQGHAQANNLRDSGYDVIVGVRPGQSFENAKVDGFDVYTPAEAARRADWIQMLTPDEVMGDVYKNEIAPNLEEGNVLGFSHGFNIHYKEIVPPANVDVVMMAPKGPGNLCRRTYVEGSGVPALYGYFQDYSGHAEDLSKEFAKGNGAARAGLLKTTFKEETEEDLFGEQNVLMGGVTALIETGYEVLTEAGYSPQLAYFEVDHEMKLICDLIYEGGFNKMYADCSNTSEYGSYVVGPKVVGKESKQAMKDALKRIQDGSFAKEFMDDYRNGFKKLYKMRERSANSLLSRVGADLRDHMSFVGEADKYSTPTEEKAEAEAEK

SEQ ID NO: 108 - DNA, 1002 bp, Staphylococcus haemolyticus
atgactaaagtttattacgatcaatcagttgagaaagatgcattacaaggtaaaaaaattgcaattatcggttacggttcacaaggacacgcgcatgcacaaaaccttaaagacaacggttatgacgttattgttggtattcgccctggtcattcttttgataaagctaaagaagatggcttcgatgtttatccagttgcagaagctgttaaacaagcagatgtcatcatggtgttattgccagatgaaatccaaggaaatgtctataaaaatgaaattgaacctaacttagaagctggaaatgccctagcatttgcgcatggttttaatatccactttgaagttatcaaaccacctaaagatgtggatgtcttcttagtagctcctaaaggacctggtcatttagtaagacgtacctttgttgaaggaactgccgtaccagcactatttggtgtacaacaagatgctactggtcaagcacgcgatatttcattaagttatgcgaaaggtatcggagctacgcgtgcaggtgtaattgaaacaacatttaaagaagaaactgaaacagatttattcggtgagcaagcagtactttgtggtggtattcataaattaatccaaagtggctttgaaactttagttgaagcgggctatcaaaaagaattagcatacttcgaagtattacatgaaatgaagttaattgttgatttaatgtatgaaggcggtatggagaacgttcgttactcaatttctaacacagcagagtatggtgactatgtttcaggacctagagtcatcactcctgatgttaaagacaatatgaaagcagtattaaaagatattcaaaatggtaattttgcaaatagctttgttaaagacaatgaaaatggctttaaagaattctataaattacgtgaacaacaacacggtcatgaaatcgaagcagttggtcgcgaattaagaaaaatgatgccattcattaaatctaaaagtattcaaaaa

SEQ ID NO: 109 - protein, 334 aa, Staphylococcus haemolyticus
MTKVYYDQSVEKDALQGKKIAIIGYGSQGHAHAQNLKDNGYDVIVGIRPGHSFDKAKEDGFDVYPVAEAVKQADVIMVLLPDEIQGNVYKNEIEPNLEAGNALAFAHGFNIHFEVIKPPKDVDVFLVAPKGPGHLVRRTFVEGTAVPALFGVQQDATGQARDISLSYAKGIGATRAGVIETTFKEETETDLFGEQAVLCGGIHKLIQSGFETLVEAGYQKELAYFEVLHEMKLIVDLMYEGGMENVRYSISNTAEYGDYVSGPRVITPDVKDNMKAVLKDIQNGNFANSFVKDNENGFKEFYKLREQQHGHEIEAVGRELRKMMPFIKSKSIQK

SEQ ID NO: 110 - DNA, 1002 bp, Staphylococcus epidermidis
atgacaaaagtatattacgacgaaacagtaactcaggatgcattacaaggtaaaaaaattgctgtcattggttatggctcacaaggacatgcacatgcacaaaatttaaaggacaatggttatgatgtagtcattggcctgcgtccaggacgatcatttaataaagctaaagaagatggatttgatgtttatacggtaagtgaagcaacacaacaagcagatgtagtgatggtactattgcctgatgaaattcaaggtgaagtatataacaaggaaattaaaccatatttagaaaaaggaaatgctttagcattcgcacacggttttaatatccatttcagtgttatcgaaccacctagtgatgtcgatgtctttttagtagcacctaaaggacctggtcatttagttagacgtacatttgttgaaggaagtgccgtaccagcattatttggtgttcaacaagatgctacaggccaagctagaaacattgctttaagctacgcaaaaggcattggtgctactcgtgccggggtcattgaaacgacatttaaagaagaaactgaaacagatttattcggtgaacaagctgtactttgtggaggagtttccaaattaattcagagtggattcgaaacacttgtggaagcaggttaccaacctgaattagcttattttgaagtcttacacgaaatgaaattaattgttgatttaatgtatgaaggcggaatggaaaatgtccgttattctatctctaacactgctgaatttggcgactatgtttctggaccaagagtaattacacctaatgttaaagaaaatatgaaaaaagtacttgaagatattcaaaatggtaactttagccgtagatttgttgaagataacaaaaatggctttaaagaattctatcaattacgtgaagatcaacatggtcatcaaattgaacaagttggacgtgaattaagagaaatgatgccattcattaaatctaaaagtattgaaaaa

SEQ ID NO: 111 - protein, 334 aa, Staphylococcus epidermidis
MTKVYYDETVTQDALQGKKIAVIGYGSQGHAHAQNLKDNGYDVVIGLRPGRSFNKAKEDGFDVYTVSEATQQADVVMVLLPDEIQGEVYNKEIKPYLEKGNALAFAHGFNIHFSVIEPPSDVDVFLVAPKGPGHLVRRTFVEGSAVPALFGVQQDATGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRVITPNVKENMKKVLEDIQNGNFSRRFVEDNKNGFKEFYQLREDQHGHQIEQVGRELREMMPFIKSKSIEK

SEQ ID NO: 112 - DNA, 1021 bp, Streptococcus pneumoniae
atgacagttcaaatggaatatgaaaaagatgttaaagtagcagcacttgacggtaaaaaaatcgccgttatcggttatggttcacaagggcatgcgcatgctcaaaacttgcgtgattcaggtcgtgacgttattatcggtgtacgtccaggtaaatcttttgataaagcaaaagaagatggatttgatacttacacagtaacagaagctactaagttggctgatgttatcatgatcttggcgccagacgaaattcaacaagaattgtacgaagcagaaatcgctccaaacttggaagctggaaacgcagttggatttgcccatggtttcaacatccactttgaatttatcaaagttcctgcggatgtagatgtcttcatgtgtgctcctaaaggaccaggacacttggtacgtcgtacttacgaagaaggatttggtgttccagctctttatgcagtataccaagatgcaacaggaaatgctaaaaacattgctatggactggtgtaaaggtgttggagcggctcgtgtaggtcttcttgaaacaacttacaaagaagaaactgaagaagatttgtttggtgaacaagctgtactttgtggtggtttgactgcccttatcgaagcaggtttcgaagtcttgacagaagcaggttacgctccagaattggcttactttgaagttcttcacgaaatgaaattgatcgttgacttgatctacgaaggtggattcaagaaaatgcgtcaatctatttcaaacactgctgaatacggtgactatgtatcaggtccacgtgtaatcactgaacaagttaaagaaaatatgaaggctgtcttggcagacatccaaaatggtaaatttgcaaatgactttgtaaatgactataaagctggacgtccaaaattgactgcttaccgtgaacaagcagctaaccttgaaattgaaaaagttggtgcagaattgcgtaaagcaatgccattcgttggtaaaaacgatgatgatgcattcaaaatctataact

SEQ ID NO: 113 - protein, 340 aa, Streptococcus pneumoniae
MTVQMEYEKDVKVAALDGKKIAVIGYGSQGHAHAQNLRDSGRDVIIGVRPGKSFDKAKEDGFDTYTVTEATKLADVIMILAPDEIQQELYEAEIAPNLEAGNAVGFAHGFNIHFEFIKVPADVDVFMCAPKGPGHLVRRTYEEGFGVPALYAVYQDATGNAKNIAMDWCKGVGAARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVNDYKAGRPKLTAYREQAANLEIEKVGAELRKAMPFVGKNDDDAFKIYN

SEQ ID NO: 114 - DNA, 1008 bp, Streptococcus pneumoniae
atggaatatgaaaaagatgttaaagtagcagcacttgacggtaaaaaaatcgccgttatcggttatggttcacaagggcatgcgcatgctcaaaacttgcgtgattcaggtcgtgacgttattatcggtgtacgtccaggtaaatcttttgataaagcaaaagaagatggatttgatacttacacagtagcagaagctactaagttggctgatgttatcatgatcttggcgccagacgaaattcaacaagaattgtacgaagcagaaatcgctccaaacttggaagctggaaacgcagttggatttgcccatggtttcaacatccactttgaatttatcaaagttcctgcggatgtagatgtcttcatgtgtgctcctaaaggaccaggacacttggtacgtcgtacttacgaagaaggatttggtgttccagctctttatgcagtataccaagatgcaacaggaaatgctaaaaacattgctatggactggtgtaaaggtgttggagcggctcgtgtaggtcttcttgaaacaacttacaaagaagaaactgaagaagatttgtttggtgaacaagctgtactttgtggtggtttgactgcccttatcgaagcaggtttcgaagtcttgacagaagcaggttacgctccagaattggcttactttgaagttcttcacgaaatgaaattgatcgttgacttgatctacgaaggtggattcaagaaaatgcgtcaatctatttcaaacactgctgaatacggtgactatgtatcaggtccacgtgtaatcactgaacaagttaaagaaaatatgaaggctgtcttggcagacatccaaaatggtaaatttgcaaatgactttgtaaatgactataaagctggacgtccaaaattgactgcttaccgtgaacaagcagctaaccttgaaattgaaaaagttggtgcagaattgcgtaaagcaatgccattcgttggtaaaaacgacgatgatgcattcaaaatctataac

SEQ ID NO: 115 - protein, 336 aa, Streptococcus pneumoniae
MEYEKDVKVAALDGKKIAVIGYGSQGHAHAQNLRDSGRDVIIGVRPGKSFDKAKEDGFDTYTVAEATKLADVIMILAPDEIQQELYEAEIAPNLEAGNAVGFAHGFNIHFEFIKVPADVDVFMCAPKGPGHLVRRTYEEGFGVPALYAVYQDATGNAKNIAMDWCKGVGAARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVNDYKAGRPKLTAYREQAANLEIEKVGAELRKAMPFVGKNDDDAFKIYN

SEQ ID NO: 116 - DNA, 1020 bp, Streptococcus sanguinis
atggcagtaacaatggaatacgaaaaagatgttaaagtagcagcgcttgacggtaaaaaaatcgccgttatcggttatggttcacaaggacatgcgcatgcacaaaacttgcgtgatacaggccacgatgtgattatcggtgttcgtcctggtaagtcatttgacaaggctaaagaagatggctttgatacttatacagtagcagaagcagctaaattagctgatgtcatcatgattttggctccagatgaaatccaacaagatctctatgaagcagaaatcgctccaaacttggaagctggaaacgcagttgggtttgctcatggtttcaacatccattttgagtttatcaaagttcctgccgatgtagatgtctttatgtgtgctcctaaaggccctggtcacttggttcgccgtactttcgaagaaggttttggtgtaccagctctgtatgcagtctaccaagacgctactggaaatgccaaagacatcgcaatggactggtgtaaaggtgttggttcagctcgtgttggacttcttgaaacaacttataaagaagaaacagaagaagatctctttggtgaacaagctgtgctttgtggtggcttgactgccctgattgaagcaggatttgaagttctgactgaagcaggttatgcgccagaattggcttactttgaagtgctgcacgaaatgaaactgattgtagacttgatctatgaaggtggcttcaagaagatgcgccaatctatctcaaatacagctgaatatggtgactatgtatctggtccgcgcgtcattactgagcaagtcaaagaaaacatgaaggcagtcttggctgatatccaaaacggtaaatttgcgaacgacttcgttgatgattacaaggctggtcgtccaaaactcactgcttaccgcgagcaagctgctaatctggagattgaaaaggtcggtgcagaattgcgtaaagcaatgccattcgttggtaaaaacgacgacgatgctttcaagatttataat

SEQ ID NO: 117 - protein, 340 aa, Streptococcus sanguinis
MAVTMEYEKDVKVAALDGKKIAVIGYGSQGHAHAQNLRDTGHDVIIGVRPGKSFDKAKEDGFDTYTVAEAAKLADVIMILAPDEIQQDLYEAEIAPNLEAGNAVGFAHGFNIHFEFIKVPADVDVFMCAPKGPGHLVRRTFEEGFGVPALYAVYQDATGNAKDIAMDWCKGVGSARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVDDYKAGRPKLTAYREQAANLEIEKVGAELRKAMPFVGKNDDDAFKIYN

SEQ ID NO: 118 - DNA, 1020 bp, Streptococcus salivarius
atggcagttcaaatggaatatgaaaaagacgtaaaagtagcagcacttgacggtaaaaaaatcgccgttatcggttacggttcacaaggtcatgcacatgcacaaaacttgcgtgatacaggtcacgatgtgattatcggtgttcgtccaggtaaatcatttgataaagctaaagaagatggttttgacacttacacagtagcagaagcaactaaattggctgatgttatcatgattttggctccagacgaaatccaacaagaactttacgaagcagaaattgctccaaaccttgaagctggtaatgctgttggttttgcacacggatttaacatccacttcgaattcatcaaagttcctaaagatgttgatgtcttcatgtgtgctcctaaaggaccaggtcacttggtacgtcgtacatttgaagaaggatttggtgttcctgcactttatgcagtataccaagatgctacaggtaacgctaaagatatcgctatggactggtgtaaaggtgttggtgcagcacgtgttggtcttcttgaaacaacatacaaagaagaaactgaagaagatttgttcggtgaacaagcagttctttgtggtggtttgactgcccttatcgaagctggttttgaagtcttgactgaagctggatatgctccagaattggcttactttgaagtgcttcacgaaatgaaattgatcgttgacttgatttacgaaggtggattcaagaaaatgcgtcaatcaatttctaacactgctgaattcggtgactacgtatcaggtccacgtgttatcactgaacaagtgaaagaaaacatgaaagcagttcttgctgacatccaaaacggtaaattcgctaacgacttcgttaacgactacaaagctggacgtccaaaacttactgcttaccgtgaagaagctgctaaccttgaaatcgaaaaagttggtgctgaattgcgtaaagcaatgccattcgttggtcaaaacgacgatgacgcattcaaaatctataac

SEQ ID NO: 119 - protein, 340 aa, Streptococcus salivarius
MAVQMEYEKDVKVAALDGKKIAVIGYGSQGHAHAQNLRDTGHDVIIGVRPGKSFDKAKEDGFDTYTVAEATKLADVIMILAPDEIQQELYEAEIAPNLEAGNAVGFAHGFNIHFEFIKVPKDVDVFMCAPKGPGHLVRRTFEEGFGVPALYAVYQDATGNAKDIAMDWCKGVGAARVGLLETTYKEETEEDLFGEQAVLCGGLTALIEAGFEVLTEAGYAPELAYFEVLHEMKLIVDLIYEGGFKKMRQSISNTAEFGDYVSGPRVITEQVKENMKAVLADIQNGKFANDFVNDYKAGRPKLTAYREEAANLEIEKVGAELRKAMPFVGQNDDDAFKIYN

SEQ ID NO: 120 - DNA, 1020 bp, Streptococcus thermophilus
atggcagttcaaatggaatatgaaaaagacgtaaaagtaccagcacttgatggtaaaaaaatcgccgttatcggttacggttcacaaggtcacgctcactcacaaaacttgcgtgatacaggtcacgatgttatcatcggtgttcgtccaggtaaatcatttgataaagctaaagaagatggttttgatacttacacagtagcagaagcaactaaattggctgatgttatcatgattttggctccagacgaaatccaacaagaactttacgaagcagaaatcgctccaaatcttgaagctggtaacgctgttggttttgctcacggtttcaacatccactttgaatttattaaagtaccagcagatgttgatgtatttatgtgtgcacctaaaggaccaggtcacttggtacgtcgtacatttgaagaaggttttggtgtacctgccctttacgcagtataccaagatgccacaggtaacgctaaagacatcgctatggactggtgtaaaggtattggtgcagcacgtgtaggtcttcttgaaacaacatacaaagaagaaactgaagaagatttgtttggtgaacaagcagttctttgtggtggtttgactgcccttatcgaaactggttttgaagtcttgactgaagctggatatgcaccagaattggcttactttgaagtacttcacgaaatgaaattaatcgttgacttgatttacgaaggtggattcaagaaaatgcgtcaatcaatttctaacactgctgaattcggtgactatgtatcaggtccacgtgttatcactgaacaagttaaagaaaacatgaaagcagttcttgctgatatccaaaatggtaaattcgctaatgacttcgttaacgactacaaagctggacgtccaaaacttactgcttaccgtgaagaagctgctaaccttgaaatcgaaaaagttggtgctgaattgcgtaaagcaatgccattcgttggtcaaaacgacgatgatgcattcaaaatctataac

SEQ ID NO: 121 - protein, 340 aa, Streptococcus thermophilus
MAVQMEYEKDVKVPALDGKKIAVIGYGSQGHAHSQNLRDTGHDVIIGVRPGKSFDKAKEDGFDTYTVAEATKLADVIMILAPDEIQQELYEAEIAPNLEAGNAVGFAHGFNIHFEFIKVPADVDVFMCAPKGPGHLVRRTFEEGFGVPALYAVYQDATGNAKDIAMDWCKGIGAARVGLLETTYKEETEEDLFGEQAVLCGGLTALIETGFEVLTEAGYAPELAYFEVLHEMKLIVDLIYEGGFKKMRQSISNTAEFGDYVSGPRVITEQVKENMKAVLADIQNGKFANDFVNDYKAGRPKLTAYREEAANLEIEKVGAELRKAMPFVGQNDDDAFKIYN

SEQ ID NO: 122 - DNA, 975 bp, Streptococcus pneumoniae
ttgacggtaaaaaaatacgccgttatcggttatggttcacaagggcatgcgcatgctcaaaacttgcgtgattcaggtcgtgacgttattataggtgtacgtccaggtaaatcttttgataaagcaaaagaagatggatttgatacttacacagtagcagaagctactaagttggctgatgttatcatgatcttggcgccagacgaaattcaacaagaattgtacgaagcagaaatcgctccaaacttggaagctggaaacgcagttggatttgcccatggtttcaacatccactttgaatttatcaaagttcctgcggatgtagatgtcttcatgtgtgctcctaaaggaccaggacacttggtacgtcgtacttacgaagaaggatttggtgttccagctctttatgcagtataccaagatgcaacaggaaatgctaaaaacattgctatggactggtgtaaaggtgttggagcggctcgtgtaggtcttcttgaaacaacttacaaagaagaaactgaagaagatttgtttggtgaacaagctgtactttgtggtggtttgactgcccttatcgaagcaggtttcgaagtcttgacagaagcaggttacgctccagaattggcttactttgaagttcttcacgaaatgaaattgatcgttgacttgatctacgaaggtggattcaagaaaatgcgtcaatctatttcaaacactgctgaatacggtgactatgtatcaggtccacgtgtaatcactgaacaagttaaagaaaatatgaaggctgtcttggcagacatccaaaatggtaaatttgcaaatgactttgtaaatgactataaagctggacgtccaaaattgactgcttaccgtgaacaagcagctaaccttgaaattgaaaaagttggtgcagaattgcgtaaagcaatgccattcgttggtaaaaacgacgatgatgcattcaaaatctataac

SEQ ID NO: 123 - protein, 325 aa, Streptococcus pneumoniae
MTVKKYAVIGYGSQGHAHAQNLRDSGRDVIIGVRPGKSFDKAKEDGFDTYTVAEATKLADVIMILAPDEIQQELYEAEIAPNLEAGNAVGFAHGFNIHFEFIKVPADVDVFMCAPKGPGHLVRRTYEEGFGVPALYAVYQDATGNAKNIAMDWCKGVGAARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVNDYKAGRPKLTAYREQAANLEIEKVGAELRKAMPFVGKNDDDAFKIYN

SEQ ID NO: 124 - DNA, 1020 bp, Lactococcus lactis
atggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcggtagctaaagctgatgttattatggttttggcgccagatgaacttcaacaatccatttatgaagaggacatcaaaccaaacttgaaagcaggttcagcacttggttttgctcacggatttaatatccattttggctatattaaagtaccagaagacgttgacgtctttatggttgcacctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacctttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccaaggattattactgacgcagttaaaaagaatatgaagcttgttttggctgatattcaatctggaaaatttgctcaagatttcgttgatgacttcaaagcggggcgtccaaaattaacagcctatcgcgaagctgctaaaaatcttgaaattgaaaaaattggggcagaattacgtaaagcaatgccattcacacaatctggtgatgacgatgcctttaaaatctatcag

SEQ ID NO: 125 - protein, 340 aa, Lactococcus lactis
MAVTMYYEDDVEVSALAGKQIAVIGYGSQGHAHAQNLRDSGHNVIIGVRHGKSFDKAKEDGFETFEVGEAVAKADVIMVLAPDELQQSIYEEDIKPNLKAGSALGFAHGFNIHFGYIKVPEDVDVFMVAPKAPGHLVRRTYTEGFGTPALFVSHQNASGHAREIAMDWAKGIGCARVGIIETTFKEETEEDLFGEQAVLCGGLTALVEAGFETLTEAGYAGELAYFEVLHEMKLIVDLMYEGGFTKMRQSISNTAEFGDYVTGPRIITDAVKKNMKLVLADIQSGKFAQDFVDDFKAGRPKLTAYREAAKNLEIEKIGAELRKAMPFTQSGDDDAFKIYQ

SEQ ID NO: 126 - DNA, 1041 bp, Leuconostoc mesenteroides
atgactacaaaaatgttttatgacaaagatattgatacaaaaccattggaaaacaaaaagattgcagttattggctatggtgcacaagggcatgctcaagcgaataatcttcgcgactcaggatttgatgtcatcatgggattgcgcccaggaaaatattttgatagtgctaaaaaagatgggttcgaagtttactcagctgctgaagcaacggcacaagcggattttgttatgatggaaacccctgacgaattacaagcggcagtttgggagaaagaagttgagcctaaccttaaggcaggttcttacattggattttctcatgggttcaacattgtttatggtttgattaagcccaatgctgatattaatgtcatgatcatcgcgccaaagggtccaggaaacattgaacgtcgccaattcgttgaaggggttgggattccttctttgtatggtgttcatcaagatcctacgggtgatacagctgaagtggccaaggcctatgcgaaaggtattggttcaggtcgcgcaggtatcttggaaacgacttttgaagaagaaacaacagaaaacttgtttggtgaacaggctgtactttgtggtggcttaacacaattgattgaggcaggatttaacacattggtggaagcaggttactcacctgaattggcttatttcgaaacatctcatgaaatgaagatgattgttgatttgatctttgaaggtggtttcgagaagatgagacatgattgctcaaatacttgtgaatatggtgaaatgttgaacggaccacgtatcatcactgaagaatcaaagcaaggaatgcgtgatgttttgaaggatatccaagatggtacttatgctaagaagtggttggcagaatacaattctggtttgaaggatttggaaaagatgcggacagagtataagagcggtttgtacgagcaaacaggtaagaaggttcgtgctatgatgccatggatttcagatgcagataagtactcgacagcagcagatactgagcaattctcagcagcaaag

SEQ ID NO: 127 - protein, 347 aa, Leuconostoc mesenteroides
MTTKMFYDKDIDTKPLENKKIAVIGYGAQGHAQANNLRDSGFDVIMGLRPGKYFDSAKKDGFEVYSAAEATAQADFVMMETPDELQAAVWEKEVEPNLKAGSYIGFSHGFNIVYGLIKPNADINVMIIAPKGPGNIERRQFVEGVGIPSLYGVHQDPTGDTAEVAKAYAKGIGSGRAGILETTFEEETTENLFGEQAVLCGGLTQLIEAGFNTLVEAGYSPELAYFETSHEMKMIVDLIFEGGFEKMRHDCSNTCEYGEMLNGPRIITEESKQGMRDVLKDIQDGTYAKKWLAEYNSGLKDLEKMRTEYKSGLYEQTGKKVRAMMPWISDADKYSTAADTEQFSAAK

SEQ ID NO: 128 - DNA, 1041 bp, Leuconostoc mesenteroides
atgactacaaaaatgttttatgacaaagatattgatacaaaaccattggaaaacaaaaagattgcagttattggctatggtgcacaagggcatgctcaagcgaataatcttcgcgtctcaggatttgatgtcatcatgggattgcgcccaggaaaatcttttgatagtgttaaaaaagatgggttcgaagtttactcagctgctgaagcaacggcacaagcggatgttgttatgatggaaacccctgacgaattacaagcggcagtttgggagaaagaagttgagcctaaccttaaggcaggttctgaccttggattttctcatgggttcaacattgtttatggtttgattaagcccaatgctgatattaatgtcatgatcattgcgccaaagggtccaggaaacattgaacgtcgccaattcgttgaagggggtgggattccttctttgtatggtgttcatcaagatcctacgggtgatacagctgaagtggccaaggcctatgcgaaaggtattggttcaggttgcgcaggtatcttggaaacgacttttgaagaagaaacaacagaagacttgtttggtgaacaagctgtactttgtggtggcttaacacaattgattgaggcaggatttaacacattggtggaagcaggttactcacctgaattggcttatttcgaaacatctcatgaaatgaagatgattgttgatttgatctttgaaggtggtttcgagaagatgagacatgattgctcaaatacttgtgaatatggtgaaatgttgaacggaccacgtatcatcactgaagaatcaaagcaaggaatgcgtgatgttttgaaggatatccaagatggtacttatgctaagaagtggttggcagaatacaattctggtttgaaggatttggaaaagatgcggacagagtataagagcggtttgtacgagcaaacaggtaagaaggttcgtgctatgatgccatggatttcagatgcagataagtactcgacagcagcagatactgagcaattctcagcagcaaag

SEQ ID NO: 129 - protein, 347 aa, Leuconostoc mesenteroides
MTTKMFYDKDIDTKPLENKKIAVIGYGAQGHAQANNLRVSGFDVIMGLRPGKSFDSVKKDGFEVYSAAEATAQADVVMMETPDELQAAVWEKEVEPNLKAGSDLGFSHGFNIVYGLIKPNADINVMIIAPKGPGNIERRQFVEGGGIPSLYGVHQDPTGDTAEVAKAYAKGIGSGCAGILETTFEEETTEDLFGEQAVLCGGLTQLIEAGFNTLVEAGYSPELAYFETSHEMKMIVDLIFEGGFEKMRHDCSNTCEYGEMLNGPRIITEESKQGMRDVLKDIQDGTYAKKWLAEYNSGLKDLEKMRTEYKSGLYEQTGKKVRAMMPWISDADKYSTAADTEQFSAAK

SEQ ID NO: 130 - DNA, 1038 bp, Lactococcus brevis
atgagtgtagaaatgttgtatgacaaggatgttaccaccaattatcttcaaggaaagaaaattgcttttatcggttatggatctcaaggccatgcccaagctaacaacttaagagattcaggttatgacgttatcgttggtgttcgcccaggacaatcatttgaaaatgccaaaatcgatggattcgatgtttacacaccagccgaagcagctcgtcgtgcagactggattcaaatgttaacgcctgatgaagttatgggtgatgtttataaaaatgaaattgcacctaaccttgaggaaggcaatgtattaggcttttcacatggcttcaacattcattataaagaaatcgtaccaccagcaaacgttgatgttgttatgatggcacctaaaggcccaggtaatctttgtcgtcgtacatacgttgaaggctccggtgttccagcattatatggttatttccaagactattcaggccatgccgaagatttatccaaggaattcgccaaaggaaatggtgcagcacgtgccggactattgaagacaaccttcaaagaagaaactgaagaagatttgtttggtgagcaaaacgtccttatgggtggtgttaccgcgctcattgaaaccggttatgaagtcttaaccgaagcaggatactcaccacagttggcatactttgaagtagatcatgaaatgaaattgatctgtgaccttatctacgaaggtgggttcaacaagatgtatgctgactgctcgaacacttctgaatatggttcatatgtagttggtccaaaggtcgttggtaaggaatccaagcaagctatgaaagacgctttgaagcggattcaagacggttcatttgctaaagaattcatggatgactaccgtaacggcttcaagaagctttacaagatgcgtgaacgttcagctaactcacttctttcacgtgttggtgctgatcttcgtgatcacatgtcatttgttggtgaagccgacaagtacagtacacctactgaagaaaaagcagaagctgaaaag

SEQ ID NO: 131 - protein, 346 aa, Lactococcus brevis
MSVEMLYDKDVTTNYLQGKKIAFIGYGSQGHAQANNLRDSGYDVIVGVRPGQSFENAKIDGFDVYTPAEAARRADWIQMLTPDEVMGDVYKNEIAPNLEEGNVLGFSHGFNIHYKEIVPPANVDVVMMAPKGPGNLCRRTYVEGSGVPALYGYFQDYSGHAEDLSKEFAKGNGAARAGLLKTTFKEETEEDLFGEQNVLMGGVTALIETGYEVLTEAGYSPQLAYFEVDHEMKLICDLIYEGGFNKMYADCSNTSEYGSYVVGPKVVGKESKQAMKDALKRIQDGSFAKEFMDDYRNGFKKLYKMRERSANSLLSRVGADLRDHMSFVGEADKYSTPTEEKAEAEK

SEQ ID NO: 132 - DNA, 1020 bp, Lactococcus lactis
atggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcag

SEQ ID NO: 133 - protein, 340 aa, Lactococcus lactis
MAVTMYYEDDVEVSALAGKQIAVIGYGSQGHAHAQNLRDSGHNVIIGVRHGKSFDKAKEDGFETFEVGEAVAKADVIMVLAPDELQQSIYEEDIKPNLKAGSALGFAHGFNIHFGYIKVPEDVDVFMVAPKAPGHLVRRTYTEGFGTPALFVSHQNASGHAREIAMDWAKGIGCARVGIIETTFKEETEEDLFGEQAVLCGGLTALVEAGFETLTEAGYAGELAYFEVLHEMKLIVDLMYEGGFTKMRQSISNTAEFGDYVTGPRIITDEVKKNMKLVLADIQSGKFAQDFVDDFKAGRPKLIAYREAAKNLEIEKIGAELRQAMPFTQSGDDDAFKIYQ

SEQ ID NO: 134 - DNA, 1002 bp, Staphylococcus hominis
atgacaaaagtttattatgatcaatcagtagaaaaagatgcactacaaggtaaaaaaatcgctattatcggttacggttctcaaggccatgcacatgctcaaaaccttaaagataacggttacgacgtaagagttggtattcgtccaggtgattcatttaataaagctaaagaagatggattagatgtttatccagtggctgaagcagttaaacaagcagacgttattatggtattacttcctgatgaaattcaaggtaatgtatataaaaatgaaattgctccaaatttagaagctggtaatgcattagcttttgcacatggatttaatattcattttaacgtcatcgaaccacctaaagatgtagatgtcttcttagtagcacctaaaggtcctggtcatctagtaagacgtacatttgttgaaggttcagctgtgccagcattatttggtgttcaacaagatgctacaggtcatgcacgtgacattgctttaagttatgcaaaaggtattggtgctacacgtgctggtgttattgaaacaacatttaaagaggaaactgaaactgacttattcggtgaacaagctgtactttgtgggggaattcataaactgattcaaagtggtttcgagacattagtggaagctggatatcaaaaagaattagcatattttgaagtactacatgaaatgaaacttatcgttgatttaatgtatgaaggcggtatggaaaatgtacgttattcaatttcaaatactgctgaatttggtgactacgtatctggtccacgtgtcattactccagatgttaaagacaatatgaaagaagtacttaaagatattcaaaatggtaatttcgctaatcgctttgttaaagataacgaaaatggatttaaagaattttatgaattgcgtgaacaacaacacggtcatgaaattgaagcagtgggtcgtgaactaagaaaaatgatgccattcattaaatctaaaagcattcaaaaa

SEQ ID NO: 135 - protein, 334 aa, Staphylococcus hominis
MTKVYYDQSVEKDALQGKKIAIIGYGSQGHAHAQNLKDNGYDVRVGIRPGDSFNKAKEDGLDVYPVAEAVKQADVIMVLLPDEIQGNVYKNEIAPNLEAGNALAFAHGFNIHFNVIEPPKDVDVFLVAPKGPGHLVRRTFVEGSAVPALFGVQQDATGHARDIALSYAKGIGATRAGVIETTFKEETETDLFGEQAVLCGGIHKLIQSGFETLVEAGYQKELAYFEVLHEMKLIVDLMYEGGMENVRYSISNTAEFGDYVSGPRVITPDVKDNMKEVLKDIQNGNFANRFVKDNENGFKEFYELREQQHGHEIEAVGRELRKMMPFIKSKSIQK

SEQ ID NO: 136 - DNA, 11 bp, Artificial sequence
  PmeI restriction site and additional 3 bp (AGT)
gtttaaacagt

SEQ ID NO: 137 - DNA, 13 bp, Artificial sequence
  SfiI restriction site
ggccctgcaggcc

SEQ ID NO: 138 - DNA, 9586 bp, Artificial sequence
  pLH556
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaactaaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggc

SEQ ID NO: 139 - DNA, 15539 bp, Artificial sequence
  Plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 140 - DNA, 1053 bp, Bifidobacterium angulatum
atggccgctactatctggtacgaaaaggatgctgatttgtccgtcttcgaaggtaagaaggtcgccgttatcggttacggttcccaaggtcacgctcatgccttaaacttgagagactctggtgttgatgttgtcgttggtttgcgtccaacctctaagtccgtcgaatacgctaaagaacaaggtttggaagttcagtctgtcgctgacgccactgctgaagccgatgtcgttatgatcttgctgccagaccaataccaggctgccgtttacaagtccgaaattgaaccaaacttgaaaccaggtgctgccttggctttcgcccacggtttcaacatccattacggttacattaagccatctgaagatcacccagttttcatggtcgctccaaagggtccaggtcacatcgtcagacgtgaatacaccaacggtagaggtgttccagtcgttgtcgctgtcgaacaagacccagatggtaaaacttggccactgtgtttagcttacgccaaggctttgggtgctttgagagctggtgctatcaagaccactttcaccgaagaaaccgaaaccgacttgtttggtgaacaagatgttttaatgggtggtatcaaccacttgtgcgacatgggtttcgatgtcttgactgaagccggttaccaaccagaaattgcttacttcgaagtttttcacgaattgaagatgttggttgacttggccaacgaaggtggtttgaacaaggctagatggtcttgttccgacaccgctcaatacggtgactacacctctactgttatcaccgaagaaaccaagaagagaatgcaataccagttgaagagaatccaagatggttccttcgctaaagaattcatggacgatcaagctgccggtgctccaaagttcaagaagttgcaggaagaatactctcacccacacttggaaaccgttggtccaaagttgagagctatgttctcctggaacaatcaagtcgacgccgacgccgacatggctgaatccttcaacggtaagatcgctagaacccaagtccaataa

SEQ ID NO: 141 - protein, 350 aa, Bifidobacterium angulatum
MAATIWYEKDADLSVFEGKKVAVIGYGSQGHAHALNLRDSGVDVVVGLRPTSKSVEYAKEQGLEVQSVADATAEADVVMILLPDQYQAAVYKSEIEPNLKPGAALAFAHGFNIHYGYIKPSEDHPVFMVAPKGPGHIVRREYTNGRGVPVVVAVEQDPDGKTWPLCLAYAKALGALRAGAIKTTFTEETETDLFGEQDVLMGGINHLCDMGFDVLTEAGYQPEIAYFEVFHELKMLVDLANEGGLNKARWSCSDTAQYGDYTSTVITEETKKRMQYQLKRIQDGSFAKEFMDDQAAGAPKFKKLQEEYSHPHLETVGPKLRAMFSWNNQVDADADMAESFNGKIARTQVQ

SEQ ID NO: 142 - DNA, 1050 bp, Bifidobacterium dentium
atggccgctcaaatctggtacgaaaacgatggtgacttgtccgtcttggatggtaagaaggtcgctatcattggttacggttctcaaggtcacgcccatgctttgaacttgagagactctggtgttgatgttgtcgttggtctgcgtccaacctctaagtccgtcgaacaagctaaagaacagggtttggaagtcaagtccgtcccagaagctgccgctgaagctgacatcattatgatcttggccccagatcaataccagagaactatttgggctaacgacatcgaaccaaatattaagccaggtgccgctatcgccttcgctcacggtttcaacatccattacggttacattaagccatctgaagatcacccagttttcatggtcgctccaaaaggtccaggtcacattgttagacgtgaatacgctaacggtagaggtgttccagtcgttgtcgctgtcgaacaagacccaagaggtgacgcttgggatatcaccttggcctacgctaaggctttgggtgctttgagagctggtgccattaagaccaccttcaaggaagaaaccgaaaccgacttgtttggtgaacaaaacgttttaatgggtggtgttaacaagttggtcgaaatgggtttcgaagtcttgaccgacgctggttaccaaccagaaatcgcctacttcgaagtttgtcacgaattgaagatgttagtcgatttgatgaacgaaggtggtttgaacaaggctagatggtcttgttccgacactgcccaatacggtgactacaccaacaccgttatcaacgaagactgcagaaagcgtatgcaataccacttgggtagaatccaagacggttctttcgctaaggaattcatcgacgatcaagatgctggtgccccaaagttcaaggaattgcaggaagaatacggtaacgttagaatcgaaactgtcggtccaaagttgcgtgctatgttctcctggaacaatggtcaagacgacgacgccgacatggctaccttcactggtaagatcgctagatcccaagtccaataa

SEQ ID NO: 143 - protein, 349 aa, Bifidobacterium dentium
MAAQIWYENDGDLSVLDGKKVAIIGYGSQGHAHALNLRDSGVDVVVGLRPTSKSVEQAKEQGLEVKSVPEAAAEADIIMILAPDQYQRTIWANDIEPNIKPGAAIAFAHGFNIHYGYIKPSEDHPVFMVAPKGPGHIVRREYANGRGVPVVVAVEQDPRGDAWDITLAYAKALGALRAGAIKTTFKEETETDLFGEQNVLMGGVNKLVEMGFEVLTDAGYQPEIAYFEVCHELKMLVDLMNEGGLNKARWSCSDTAQYGDYTNTVINEDCRKRMQYHLGRIQDGSFAKEFIDDQDAGAPKFKELQEEYGNVRIETVGPKLRAMFSWNNGQDDDADMATFTGKIARSQVQ

SEQ ID NO: 144 - DNA, 26 bp, Artificial sequence
  Primer K9_56_58_060210f
  misc_feature (7)..(8): n is a, c, g, or t
  misc_feature (13)..(14): n is a, c, g, or t
gaaggannkaaannktggaagagagc

SEQ ID NO: 145 - DNA, 26 bp, Artificial sequence
  Primer K9_56_58_060210r
  misc_feature (13)..(14): n is a, c, g, or t
  misc_feature (19)..(20): n is a, c, g, or t
gctctcttccamnntttmnntccttc

SEQ ID NO: 146 - DNA, 37 bp, Artificial sequence
  K9_30_101110f primer
  misc_feature (20)..(21): n is a, c, g, or t
gactatcgccgttatcggtnnkggttctcaaggtcac

SEQ ID NO: 147 - DNA, 37 bp, Artificial sequence
  Primer K9_30_101110r
  misc_feature (17)..(18): n is a, c, g, or t
gtgaccttgagaaccmnnaccgataacggcgatagtc

SEQ ID NO: 148 - DNA, 37 bp, Artificial sequence
  Primer K9_67_101110f
  misc_feature (18)..(19): n is a, c, g, or t
gagctgaagaacaaggtnnkgaagtctacaccgctgc

SEQ ID NO: 149 - DNA, 37 bp, Artificial sequence
  Primer K9_67_101110r
  misc_feature (19)..(20): n is a, c, g, or t
gcagcggtgtagacttcmnnaccttgttcttcagctc

SEQ ID NO: 150 - DNA, 35 bp, Artificial sequence
  Primer K9_131_101110f
  misc_feature (18)..(19): n is a, c, g, or t
caaaggacgttgatgtcnnkatgatcgctccaaag

SEQ ID NO: 151 - DNA, 34 bp, Artificial sequence
  Primer K9_131_101110r
  misc_feature (17)..(18): n is a, c, g, or t
ctttggagcgatcatmnngacatcaacgtccttt

SEQ ID NO: 152 - DNA, 33 bp, Artificial sequence
  Primer K9_162_101110f
  misc_feature (16)..(17): n is a, c, g, or t
gctgtcgaacaagacnnkactggcaaggctttg

SEQ ID NO: 153 - DNA, 33 bp, Artificial sequence
  Primer K9_162_101110r
  misc_feature (17)..(18): n is a, c, g, or t
caaagccttgccagtmnngtcttgttcgacagc

SEQ ID NO: 154 - DNA, 38 bp, Artificial sequence
  Primer K9_176_101110f
  misc_feature (19)..(20): n is a, c, g, or t
gctttggcctacgctttannkatcggtggtgctagagc

SEQ ID NO: 155 - DNA, 38 bp, Artificial sequence
  Primer K9_176_101110r
  misc_feature (19)..(20): n is a, c, g, or t
gctctagcaccaccgatmnntaaagcgtaggccaaagc

SEQ ID NO: 156 - DNA, 33 bp, Artificial sequence
  Primer K9_191_101110f
  misc_feature (16)..(17): n is a, c, g, or t
gaaactaccttcagannkgaaactgaaaccgac

SEQ ID NO: 157 - DNA, 33 bp, Artificial sequence
  K9_191_101110r
  misc_feature (17)..(18): n is a, c, g, or t
gtcggtttcagtttcmnntctgaaggtagtttc

SEQ ID NO: 158 - DNA, 35 bp, Artificial sequence
  Primer K9_227_101110f
  misc_feature (16)..(17): n is a, c, g, or t
gccggttacgacccannkaacgcttacttcgaatg

SEQ ID NO: 159 - DNA, 35 bp, Artificial sequence
  Primer K9_227_101110r
  misc_feature (19)..(20): n is a, c, g, or t
cattcgaagtaagcgttmnntgggtcgtaaccggc

SEQ ID NO: 160 - DNA, 37 bp, Artificial sequence
  Primer K9_246_101110f
  misc_feature (16)..(17): n is a, c, g, or t
gttgacttgatctacnnktctggtttctccggtatgc

SEQ ID NO: 161 - DNA, 37 bp, Artificial sequence
  Primer K9_246_101110r
  misc_feature (21)..(22): n is a, c, g, or t
gcataccggagaaaccagamnngtagatcaagtcaac

SEQ ID NO: 162 - DNA, 41 bp, Artificial sequence
  Primer K9_37&39_101110f
  misc_feature (18)..(19): n is a, c, g, or t
  misc_feature (24)..(25): n is a, c, g, or t
gttctcaaggtcacgctnnkgccnnkaatgctaaggaatcc

SEQ ID NO: 163 - DNA, 41 bp, Artificial sequence
  Primer K9_37&39_101110r
  misc_feature (17)..(18): n is a, c, g, or t
  misc_feature (23)..(24): n is a, c, g, or t
ggattccttagcattmnnggcmnnagcgtgaccttgagaac

SEQ ID NO: 164 - DNA, 38 bp, Artificial sequence
  Primer K9_86&87_101110f
  misc_feature (19)..(20): n is a, c, g, or t
  misc_feature (22)..(23): n is a, c, g, or t
gacatcattatgatcttgnnknnkgatgaaaagcaggc

SEQ ID NO: 165 - DNA, 38 bp, Artificial sequence
  Primer K9_86&87_101110r
  misc_feature (16)..(17): n is a, c, g, or t
  misc_feature (19)..(20): n is a, c, g, or t
gcctgcttttcatcmnnmnncaagatcataatgatgtc

SEQ ID NO: 166 - DNA, 27 bp, Artificial sequence
  Primer K9_131L_112210f
ggacgttgatgtcttgatgatcgctcc

SEQ ID NO: 167 - DNA, 27 bp, Artificial sequence
  Primer K9_131A_112210f
ggacgttgatgtcgcaatgatcgctcc

SEQ ID NO: 168 - DNA, 27 bp, Artificial sequence
  Primer K9_131V_112210f
ggacgttgatgtcgttatgatcgctcc

SEQ ID NO: 169 - DNA, 27 bp, Artificial sequence
  Primer K9_131M_112210f
ggacgttgatgtcatgatgatcgctcc

SEQ ID NO: 170 - DNA, 27 bp, Artificial sequence
  Primer K9_131C_112210f
ggacgttgatgtctgaatgatcgctcc

SEQ ID NO: 171 - DNA, 30 bp, Artificial sequence
  Primer K9_191D_112210r
ggtttcagtttcgtctctgaaggtagtttc

SEQ ID NO: 172 - DNA, 30 bp, Artificial sequence
  Primer K9_191C_112210r
ggtttcagtttcgcatctgaaggtagtttc

SEQ ID NO: 173 - DNA, 30 bp, Artificial sequence
  Primer K9_191S_112210r
ggtttcagtttccgatctgaaggtagtttc

SEQ ID NO: 174 - DNA, 30 bp, Artificial sequence
  Primer K9_191G_112210r
ggtttcagtttcgcctctgaaggtagtttc

SEQ ID NO: 175 - DNA, 11864 bp, Artificial sequence
  pHR81-PCUP1-AlsS-PILV5-Pf5.KARI (pLH550) plasmid
catcatcacagtttaaacagtatgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaactaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 176 - DNA, 11871 bp, Artificial sequence
  pYZ058 (pHR81-PCUP1-AlsS-PILV5-yeast KARI plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatgttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 177 - DNA, 52 bp, Artificial sequence
  Primer OT1349
catcatcacagtttaaacagtatgaaagttttctacgataaagactgcgacc

SEQ ID NO: 178 - DNA, 51 bp, Artificial sequence
  Primer OT1318
gcacttgataggcctgcagggccttagttcttggctttgtcgacgattttg

SEQ ID NO: 179 - DNA, 15 bp, Artificial sequence
  Primer OT1383
ctagtcaccggtggc

SEQ ID NO: 180 - DNA, 15 bp, Artificial sequence
  Primer OT1384
ggccgccaccggtga

SEQ ID NO: 181 - DNA, 9612 bp, Artificial sequence
  pHR81::ILV5p-K9D3  (pLH702) plasmid
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgatattttcctctggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 182 - DNA, 12896 bp, artificial sequence
  pBP915 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 183 - DNA, 22 bp, artificial sequence
  primer oBP594
agctgtctcgtgttgtgggttt

SEQ ID NO: 184 - DNA, 49 bp, artificial sequence
  primer oBP595
cttaataatagaacaatatcatcctttacgggcatcttatagtgtcgtt

SEQ ID NO: 185 - DNA, 49 bp, artificial sequence
  primer oBP596
gcgccaacgacactataagatgcccgtaaaggatgatattgttctatta

SEQ ID NO: 186 - DNA, 49 bp, artificial sequence
  primer oBP597
tatggaccctgaaaccacagccacattgcaacgacgacaatgccaaacc

SEQ ID NO: 187 - DNA, 49 bp, artificial sequence
  primer oBP598
tccttggtttggcattgtcgtcgttgcaatgtggctgtggtttcagggt

SEQ ID NO: 188 - DNA, 49 bp, artificial sequence
  primer oBP599
atcctctcgcggagtccctgttcagtaaaggccatgaagctttttcttt

SEQ ID NO: 189 - DNA, 49 bp, artificial sequence
  primer oBP600
attggaaagaaaaagcttcatggcctttactgaacagggactccgcgag

SEQ ID NO: 190 - DNA, 22 bp, artificial sequence
  primer oBP601
tcataccacaatcttagaccat

SEQ ID NO: 191 - DNA, 21 bp, artificial sequence
  primer oBP602
tgttcaaacccctaaccaacc

SEQ ID NO: 192 - DNA, 22 bp, artificial sequence
  primer oBP603
tgttcccacaatctattaccta

SEQ ID NO: 193 - DNA, 21 bp, artificial sequence
  primer oBP605
tactgaacagggactccgcga

SEQ ID NO: 194 - DNA, 21 bp, artificial sequence
  primer oBP606
tcataccacaatcttagacca

SEQ ID NO: 195 - DNA, 11856 bp, Artificial sequence
  Plasmid pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 196 - protein, 338 aa, Artificial sequence
  K9_David_SH
MAKIYYQEDCNLSLLDGKTIAVIGYGSQGHAHALNAKESGCNVIIGLFEGAEEWKRAEEQGFEVYTAAEAAKKADIIMILIPDEMQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 197 - DNA, 34 bp, artificial sequence
  primer oBP562
aattgtttaaacatgtatacagtaggtgactatc

SEQ ID NO: 198 - DNA, 49 bp, artificial sequence
  primer oBP563
aatcataaatcataagaaattcgcttatcagctcttgttttgttctgca

SEQ ID NO: 199 - DNA, 49 bp, artificial sequence
  primer oBP564
ttatttgcagaacaaaacaagagctgataagcgaatttcttatgattta

SEQ ID NO: 200 - DNA, 34 bp, artificial sequence
  primer oBP565
aattggccggccaaaaaaagcatgcacgtataca

SEQ ID NO: 201 - DNA, 32 bp, artificial sequence
  primer oBP505
aattgagctcactgtagccctagacttgatag

SEQ ID NO: 202 - DNA, 35 bp, artificial sequence
  primer oBP506
aattggcgcgcctgtatatgagatagttgattgta

SEQ ID NO: 203 - DNA, 35 bp, artificial sequence
  primer oBP507
aattttaattaagtctaggttctttggctgttcaa

SEQ ID NO: 204 - DNA, 33 bp, artificial sequence
  primer oBP508
aattgtcgactttagaagtgtcaacaacgtatc

SEQ ID NO: 205 - DNA, 34 bp, artificial sequence
  primer oBP674
aattggcgcgccaattaccgtcgctcgtgatttg

SEQ ID NO: 206 - DNA, 34 bp, artificial sequence
  primer oBP675
aattgtttaaacttgaatatgtattacttggtta

SEQ ID NO: 207 - DNA, 22 bp, artificial sequence
  primer oBP495
ggagatatacaatagaacagat

SEQ ID NO: 208 - DNA, 22 bp, artificial sequence
  primer oBP496
tagcaatggggtttttttcagt

SEQ ID NO: 209 - DNA, 8366 bp, Artificial Sequence
  pRS316-UAS(PGK1)-PFBA1-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 210 - DNA, 22 bp, Artificial sequence
  primer N160SeqF5
cctgaagtctaggtccctattt

SEQ ID NO: 211 - DNA, 20 bp, Artificial sequence
  N886 primer
caatgattgttggtaaaggg

SEQ ID NO: 212 - DNA, 32 bp, Artificial sequence
  Primer oBP622
aattggtaccccaaaaggaatattgggtcaga

SEQ ID NO: 213 - DNA, 49 bp, Artificial sequence
  Primer oBP623
ccattgtttaaacggcgcgccggatcctttgcgaaaccctatgctctgt

SEQ ID NO: 214 - DNA, 49 bp, Primer oBP624
gcaaaggatccggcgcgccgtttaaacaatggaaggtcgggatgagcat

SEQ ID NO: 215 - DNA, 34 bp, Artificial sequence
  Primer oBP625
aattggccggcctacgtaacattctgtcaaccaa

SEQ ID NO: 216 - DNA, 34 bp, Artificial sequence
  Primer oBP626
aattgcggccgcttcatatatgacgtaataaaat

SEQ ID NO: 217 - DNA, 34 bp, Artificial sequence
  Primer oBP627
aattttaattaattttttttcttggaatcagtac

SEQ ID NO: 218 - DNA, 40 bp, Artificial sequence
  Primer HY21
ttaaggcgcgcctatttgtaatacgtatacgaattccttc

SEQ ID NO: 219 - DNA, 56 bp, Artificial sequence
  Primer HY24
acttaataactttaccggctgttgacattttgttcttcttgttattgtattgtgtt

SEQ ID NO: 220 - DNA, 56 bp, Artificial sequence
  Primer HY25
aacacaatacaataacaagaagaacaaaatgtcaacagccggtaaagttattaagt

SEQ ID NO: 221 - DNA, 40 bp, Artificial sequence
  Primer HY4
ggaagtttaaacaccacaggtgttgtcctctgaggacata

SEQ ID NO: 222 - DNA, 30 bp, Artificial sequence
  Primer URA3-end F
gcatatttgagaagatgcggccagcaaaac

SEQ ID NO: 223 - DNA, 22 bp, Artificial sequence
  Primer oBP636
catttttttccctctaagaagc

SEQ ID NO: 224 - DNA, 22 bp, Artificial sequence
  Primer oBP637
tttttgcacagttaaactaccc

SEQ ID NO: 225 - DNA, 40 bp, Artificial sequence
  Primer oBP691
aattggatccgcgatcgcgacgttctctccgttgttcaaa

SEQ ID NO: 226 - DNA, 41 bp, Artificial sequence
  Primer oBP692
aattggcgcgccatttaaatatatatgtatatatataacac

SEQ ID NO: 227 - DNA, 34 bp, Artificial sequence
  Primer oBP693
aattgtttaaacaaaggatgatattgttctatta

SEQ ID NO: 228 - DNA, 33 bp, Artificial sequence
  Primer oBP694
aattggccggccgcaacgacgacaatgccaaac

SEQ ID NO: 229 - DNA, 34 bp, Artificial sequence
  Primer oBP695
aattgcggccgcatgacaggtgaaagaattgaaa

SEQ ID NO: 230 - DNA, 34 bp, Artificial sequence
  Primer oBP696
aattttaattaaacgggcatcttatagtgtcgtt

SEQ ID NO: 231 - DNA, 40 bp, Artificial sequence
  Primer HY16
ttaaggcgcgccccgcacgccgaaatgcatgcaagtaacc

SEQ ID NO: 232 - DNA, 56 bp, Artificial sequence
  Primer HY19
acttaataactttaccggctgttgacattttgattgatttgactgtgttattttgc

SEQ ID NO: 233 - DNA, 56 bp, Artificial sequence
  Primer HY20
gcaaaataacacagtcaaatcaatcaaaatgtcaacagccggtaaagttattaagt

SEQ ID NO: 234 - DNA, 22 bp, Artificial sequence
  Primer oBP730
ttgctccaaagagatgtcttta

SEQ ID NO: 235 - DNA, 22 bp, Artificial sequence
  Primer oBP731
tgttcccacaatctattaccta

SEQ ID NO: 236 - DNA, 34 bp, Artificial sequence
  Primer HY31
gccgactttatggcgaagaagtttgctcttgatc

SEQ ID NO: 237 - DNA, 38 bp, Artificial sequence
  N1179 primer
gcgaattctgatctgatgcgctttgcatatctcatatt

SEQ ID NO: 238 - DNA, 38 bp, Artificial sequence
  N1180 primer
gcggtaccgccgtttcggcttggatacgccatatgcaa

SEQ ID NO: 239 - DNA, 38 bp, Artificial sequence
  N1181 primer
gccgatcgtgtaccaacctgcatttctttccgtcatat

SEQ ID NO: 240 - DNA, 38 bp, Artificial sequence
  N1182 primer
gcgcatgcgtgtaccttttgattggaattggttcgcag

SEQ ID NO: 241 - DNA, 30 bp, Artificial sequence
  N1212 primer
ttctatgttaaattttaacgatgtagacac

SEQ ID NO: 242 - DNA, 30 bp, Artificial sequence
  N1213 primer
atggcgaaatggcagtactcgggggaatgc

SEQ ID NO: 243 - DNA, 25 bp, Artificial sequence
  Primer N1239
gacgaggataatgtgcatgaacggg

SEQ ID NO: 244 - DNA, 24 bp, Artificial sequence
  Primer N1242
gtttcgttgcgttggtggaatggc

SEQ ID NO: 245 - DNA, 28 bp, Artificial sequence
  Primer N1249
gctttatggaccctgaaaccacagccac

SEQ ID NO: 246 - DNA, 27 bp, Artificial sequence
  Primer N1250
ggaaagaaaaagcttcatggccttgcg

SEQ ID NO: 247 - DNA, 23 bp, Artificial sequence
  Primer N1251
ccaatgtggctgtggtttcaggg

SEQ ID NO: 248 - DNA, 26 bp, Artificial sequence
  Primer N1252
gcaaggccatgaagctttttctttcc

SEQ ID NO: 249 - DNA, 62 bp, Primer N1253
ggaaagaaaaagcttcatggccttgcgctcatcaacactaaaattagagtcattctaattgc

SEQ ID NO: 250 - DNA, 29 bp, Artificial sequence
  Primer N1254
ttatccacggaagatatgatgaggtgacg

SEQ ID NO: 251 - DNA, 64 bp, Primer N1255
ggaccctgaaaccacagccacattggtaccttccttgccaaagggattaaacctgacaattacc

SEQ ID NO: 252 - DNA, 29 bp, Artificial sequence
  Primer N1256
acctagctaaactaagtaaatctgtatac

SEQ ID NO: 253 - DNA, 29 bp, Artificial sequence
  Primer N1257
gatgatgctatttggtgcagagggtgatg

SEQ ID NO: 254 - DNA, 60 bp, Artificial sequence
  Primer N1258
cagatttacttagtttagctaggtgtatcaaaatacgttctcaatgttctatttcccgcc

SEQ ID NO: 255 - DNA, 24 bp, Artificial sequence
  Primer N1262
cacgtaagggcatgatagaattgg

SEQ ID NO: 256 - DNA, 26 bp, Artificial sequence
  Primer N1263
ggatatagcagttgttgtacactagc

SEQ ID NO: 257 - DNA, 24 bp, Artificial sequence
  primer N1223
caaggaattaccatcaccgtcacc

SEQ ID NO: 258 - DNA, 27 bp, Artificial sequence
  primer N1225
cttgtgtataatgataaattggttggg

SEQ ID NO: 259 - DNA, 27 bp, Artificial sequence
  Primer N1228
caacggttcatcatctcatggatctgc

SEQ ID NO: 260 - DNA, 26 bp, Artificial sequence
  Primer N1229
gttacttggttctggcgaggtattgg

SEQ ID NO: 261 - DNA, 25 bp, Artificial sequence
  Primer N1230
gtaagaaggttggtattccagctgg

SEQ ID NO: 262 - DNA, 26 bp, Artificial sequence
  Primer N1231
ctgtttcgataccagaacctagaccg

SEQ ID NO: 263 - DNA, 1017 bp, Artificial sequence
  K9_David_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaatgcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 264 - DNA, 31 bp, Artificial sequence
  Primer pOLE1-NgoMI
cgtggccggccgtgcaaaaactaactccgag

SEQ ID NO: 265 - DNA, 34 bp, Artificial sequence
  Primer pOLE1-PmlI
gtactcacgtgtttgttgtaatgttttagtgctg

SEQ ID NO: 266 - protein, 338 aa, Artificial sequence
  K9_Eliza_SH
MAKIYYQEDCNLSLLDGKTIAVIGYGSQGHAHALNAKESGCNVIIGLFEDAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 267 - protein, 338 aa, Artificial sequence
  K9_Frank_SH
MAKIYYQEDCNLSLLDGKTIAVIGYGSQGHAHALNAKESGCNVIIGLFEGAEEWKRAEEQGFEVYTAAEAAKKADIIMILIPDEKLATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 268 - DNA, 4236 bp, artificial sequence
  Synthetic construct
gatccgcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 269 - DNA, 17 bp, Artificial sequence
  M13 forward primer
gtaaaacgacggccagt

SEQ ID NO: 270 - DNA, 22 bp, Artificial sequence
  M13 reverse primer
cacacaggaaacagctatgacc

SEQ ID NO: 271 - DNA, 7523 bp, Artificial sequence
  Construct
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 272 - DNA, 47 bp, Artificial sequence
  upper primer for pYZ058 construction
catcatcacagtttaaacagtatgttgaagcaaatcaacttcggtgg

SEQ ID NO: 273 - DNA, 48 bp, Artificial sequence
  lower primer for pYZ058 construction
ggacgggccctgcaggccttattggttttctggtctcaactttctgac

SEQ ID NO: 274 - DNA, 1005 bp, Clostridium beijerinckii
atgccaaagatgtactacgaaaaggacactgatttgaacttgttgagaggtaagaaggtcgccattatcggttacggttcccaaggtcacgctcatgccttgaacttgcacgaatctggtgtcgacgttgtcgttggtttgtacaacggttctaagtcctgggctaaggctgaagctgctggtctgcaagtcgccaccgttgctgacgctgccaaggctgccgatttgatcatgattttgctgccagatgaaaagcaagctaaaatctacaacgaagaaattgctccaaacttggaagaaggtaatgccttggttttcgctcacggtttcaacatccatttcggtcaagtcgttccaccatcctacgtcgacgttttcatggtcgctccaaagggtccaggtcacttggttagacgtacctacactgaaggtgctggtgtcccatgtttgatcgctgttcatcaagatgccactggtaaagctaaacagtacgctttggcctacgctaacggtattggtggtgccagagctggtgtcttggaaaccaccttcaaggacgaaaccgaaaccgacttgttcggtgaacaagctgtcttatgtggtggtgtttctgaattgatcaaggctggttttgaaaccttggtcgaagccggttacgctccagaaaacgcttacttcgaatgcatgcacgaaatgaagttgattgttgacttgttgtaccaaggtggtttatccatgatgagatactctatctccgacactgctgaatacggtgactaccagattggtagaagaatcattaccgacgaaaccaagaaggaaatgaagaaggttttgaccgaaatccaagatggtactttcgctaagaactggctgttggaaaaccagaccaatagaccaggtttcaacgccagaagaagaatggaagctgaacacccaatcgaaaaggttggtaaggaattgagaggtatgatgtcctggatcgacaccgctaaggttgattaa

SEQ ID NO: 275 - protein, 334 aa, Clostridium beijerinckii
MPKMYYEKDTDLNLLRGKKVAIIGYGSQGHAHALNLHESGVDVVVGLYNGSKSWAKAEAAGLQVATVADAAKAADLIMILLPDEKQAKIYNEEIAPNLEEGNALVFAHGFNIHFGQVVPPSYVDVFMVAPKGPGHLVRRTYTEGAGVPCLIAVHQDATGKAKQYALAYANGIGGARAGVLETTFKDETETDLFGEQAVLCGGVSELIKAGFETLVEAGYAPENAYFECMHEMKLIVDLLYQGGLSMMRYSISDTAEYGDYQIGRRIITDETKKEMKKVLTEIQDGTFAKNWLLENQTNRPGFNARRRMEAEHPIEKVGKELRGMMSWIDTAKVD

SEQ ID NO: 276 - DNA, 1020 bp, Zymomonas mobilis
atgaaagtttactacgattctgacgccgacctgggcctcatcaaatctaagaaaattgccatcctcggctacggttcccagggccacgctcatgcacagaacctgcgcgattccggcgtagcggaagtggctattgccctgcgtccagactcggcttccgttaagaaggctcaagacgccggcttcaaagtgctcaccaatgctgaagccgctaagtgggccgacatcctcatgatcctggccccggacgagcaccaggccgcgatctacgcggaggacctcaaggacaacctccgcccgggctccgctatcgccttcgcccacggcctcaacatccacttcggcctgattgagcctcgtaaggacatcgacgtgttcatgatcgcgccgaagggtccaggccacaccgtacgttccgagtacgtccgcggcggtggtgttccttgcctggtcgcggtcgaccaggacgcttccggcaacgcccacgacattgccctggcctacgcctcaggcatcggcggcggccgttccggcgtcatcgaaaccaccttccgcgaggaggttgaaaccgacctgttcggtgagcaggctgttctgtgtggcggtctcaccgcgctgatcacagccggtttcgaaaccctgactgaagctggctacgctccagaaatggccttcttcgagtgcatgcacgaaatgaagctgatcgttgacctcatctacgaagccggtatcgccaacatgcgctactcgatctccaacaccgctgaatacggcgacatcgtgtctggtccacgcgtcatcaacgaggaatccaaaaaggccatgaaggctattctggacgacatccagagcggccgcttcgtgtcgaagttcgtcctcgacaaccgcgccggccagccagagttgaaggccgcgcgtaaacgcatggctgctcaccctatcgaacaggtcggcgcgcgcctgcgcaagatgatgccttggatcgcttccaacaaactcgtcgacaaagcccgcaactaa

SEQ ID NO: 277 - protein, 339 aa, Zymomonas mobilis; identical to SEQ ID NO: 11

SEQ ID NO: 278 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 279 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 280 - DNA, 804 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 281 - DNA, 30 bp, Artificial sequence
  N1214 primer
aaaaagggggtagaagcgttttgaagctat

SEQ ID NO: 282 - DNA, 62 bp, Artificial sequence
  N1176 primer
gcatagcaatctaatctaagttccagctgaggatgacaacagattactcatcaccagcatat

SEQ ID NO: 283 - DNA, 62 bp, Artificial sequence
  N1117 primer
atcaacacacaaacactaaatcaaagctgaggatggatttatttgagtcattagcacaaaaa

SEQ ID NO: 284 - DNA, 800 bp, Saccharomyces cerevisiae
ccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaa

SEQ ID NO: 285 - DNA, 44 bp, Artificial sequence
  N822 primer
cgcctcagctttgatttagtgtttgtgtgttgataagcagttgc

SEQ ID NO: 286 - DNA, 63 bp, Artificial sequence
  N1178 primer
ggtatcgataagcttgatatcgaattcctgcgcccgggccactagtcagatgccgcgggcact

SEQ ID NO: 287 - DNA, 38 bp, Artificial sequence
  N821 primer
cgcccgggccactagtcagatgccgcgggcacttgagc

SEQ ID NO: 288 - DNA, 30 bp, Artificial sequence
  N1115 primer
tttttgtgctaatgactcaaataaatccat

SEQ ID NO: 289 - DNA, 30 bp, Artificial sequence
  N1110 primer
gcgatttaatctctaattattagttaaagt

SEQ ID NO: 290 - DNA, 30 bp, Artificial sequence
  N1114 primer
atatgctggtgatgagtaatctgttgtcat

SEQ ID NO: 291 - DNA, 9220 bp, Artificial sequence
  pUC19-URA3::pdc1::TEF(M4)-xpk1::kan Plasmid
ccgcattgcggattacgtattctaatgttcagataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatccagtgatgatacaacgagttagccaaggtgggggatcctctagagtcttaaggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgcggtggttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttttatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaa

SEQ ID NO: 292 - DNA, 38 bp, artificial sequence
  primer BK468
gcctcgagttttaatgttacttctcttgcagttaggga

SEQ ID NO: 293 - DNA, 10934 bp, Artificial sequence
  pRS423::TEF(M4)-xpk1+ENO1-eutD
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcgcccgggccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 294 - DNA, 80 bp, Artificial sequence
  Primer
ttccggtttctttgaaatttttttgattcggtaatctccgagcagaaggagcattgcggattacgtattctaatgttcag

SEQ ID NO: 295 - DNA, 81 bp, Artificial sequence
  Primer
gggtaataactgatataattaaattgaagctctaatttgtgagtttagtacaccttggctaactcgttgtatcatcactgg

SEQ ID NO: 296 - DNA, 38 bp, Artificial sequence; identical to SEQ ID NO: 292
  Primer

SEQ ID NO: 297 - DNA, 31 bp, Artificial sequence
  Primer
gctaaattcgagtgaaacacaggaagaccag

SEQ ID NO: 298 - DNA, 24 bp, Artificial sequence
  Primer
ttctcgacgtgggcctttttcttg

SEQ ID NO: 299 - DNA, 49 bp, Artificial sequence
  Primer
tgcagctttaaataatcggtgtcactactttgccttcgtttatcttgcc

SEQ ID NO: 300 - DNA, 49 bp, Artificial sequence
  Primer
gagcaggcaagataaacgaaggcaaagtagtgacaccgattatttaaag

SEQ ID NO: 301 - DNA, 49 bp, Artificial sequence
  Primer
tatggaccctgaaaccacagccacattgtaaccaccacgacggttgttg

SEQ ID NO: 302 - DNA, 49 bp, Artificial sequence
  Primer
tttagcaacaaccgtcgtggtggttacaatgtggctgtggtttcagggt

SEQ ID NO: 303 - DNA, 49 bp, Artificial sequence
  Primer
ccagaaaccctatacctgtgtggacgtaaggccatgaagctttttcttt

SEQ ID NO: 304 - DNA, 49 bp, Artificial sequence
  Primer
attggaaagaaaaagcttcatggccttacgtccacacaggtatagggtt

SEQ ID NO: 305 - DNA, 22 bp, Artificial sequence
  Primer
cataagaacacctttggtggag

SEQ ID NO: 306 - DNA, 22 bp, Artificial sequence
  Primer
aggattatcattcataagtttc

SEQ ID NO: 307 - DNA, 23 bp, Artificial sequence
  Primer
ttcttggagctgggacatgtttg

SEQ ID NO: 308 - DNA, 22 bp, Artificial sequence
  Primer
tgatgatatttcataaataatg

SEQ ID NO: 309 - DNA, 23 bp, Artificial sequence
  Primer
atgcgtccatctttacagtcctg

SEQ ID NO: 310 - DNA, 22 bp, Artificial sequence
  Primer
tacgtacggaccaatcgaagtg

SEQ ID NO: 311 - DNA, 49 bp, Artificial sequence
  Primer
aattcgtttgagtacactactaatggctttgttggcaatatgtttttgc

SEQ ID NO: 312 - DNA, 49 bp, Artificial sequence
  Primer
atatagcaaaaacatattgccaacaaagccattagtagtgtactcaaac

SEQ ID NO: 313 - DNA, 49 bp, Artificial sequence
  Primer
tatggaccctgaaaccacagccacattcttgttatttataaaaagacac

SEQ ID NO: 314 - DNA, 49 bp, Artificial sequence
  Primer
ctcccgtgtctttttataaataacaagaatgtggctgtggtttcagggt

SEQ ID NO: 315 - DNA, 49 bp, Artificial sequence
  Primer
taccgtaggcgtccttaggaaagatagaaggccatgaagctttttcttt

SEQ ID NO: 316 - DNA, 49 bp, Artificial sequence
  Primer
attggaaagaaaaagcttcatggccttctatctttcctaaggacgccta

SEQ ID NO: 317 - DNA, 21 bp, Artificial sequence
  Primer
ttattgtttggcatttgtagc

SEQ ID NO: 318 - DNA, 22 bp, Artificial sequence
  Primer
ccaagcatctcataaacctatg

SEQ ID NO: 319 - DNA, 22 bp, Artificial sequence
  Primer
tgtgcagatgcagatgtgagac

SEQ ID NO: 320 - DNA, 17 bp, Artificial sequence
  Primer
agttattgataccgtac

SEQ ID NO: 321 - DNA, 19 bp, Artificial sequence
  Primer
cgagataccgtaggcgtcc

SEQ ID NO: 322 - DNA, 2237 bp, Artificial sequence
  Fragment
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattatt

SEQ ID NO: 323 - DNA, 4420 bp, Artificial sequence
  Cassette
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaaaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 324 - DNA, 3521 bp, Artificial sequence
  Cassette
aaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttctactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 325 - DNA, 2686 bp, Artificial sequence
  Plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 326 - DNA, 24 bp, Artificial sequence
  Primer
ttatgtatgctcttctgacttttc

SEQ ID NO: 327 - DNA, 49 bp, Artificial sequence
  Primer
aataattagagattaaatcgctcattttttgccagtttcttcaggcttc

SEQ ID NO: 328 - DNA, 49 bp, Artificial sequence
  Primer
agcctgaagaaactggcaaaaaatgagcgatttaatctctaattattag

SEQ ID NO: 329 - DNA, 49 bp, Artificial sequence
  Primer
tatggaccctgaaaccacagccacatttttcaatcattggagcaatcat

SEQ ID NO: 330 - DNA, 49 bp, Artificial sequence
  Primer
taaaatgattgctccaatgattgaaaaatgtggctgtggtttcagggtc

SEQ ID NO: 331 - DNA, 49 bp, Artificial sequence
  Primer
accgtaggtgttgtttgggaaagtggaaggccatgaagctttttctttc

SEQ ID NO: 332 - DNA, 49 bp, Artificial sequence
  Primer
ttggaaagaaaaagcttcatggccttccactttcccaaacaacacctac

SEQ ID NO: 333 - DNA, 23 bp, Artificial sequence
  Primer
ttattgcttagcgttggtagcag

SEQ ID NO: 334 - DNA, 57 bp, Artificial sequence
  Primer
aattggatccggcgcgccgtttaaacggccggccaatgtggctgtggtttcagggtc

SEQ ID NO: 335 - DNA, 49 bp, Artificial sequence
  Primer
aatttctagattaattaagcggccgcaaggccatgaagctttttctttc

SEQ ID NO: 336 - DNA, 21 bp, Artificial sequence
  Primer
tttttggtggttccggcttcc

SEQ ID NO: 337 - DNA, 22 bp, Artificial sequence
  Primer
aaagttggcatagcggaaactt

SEQ ID NO: 338 - DNA, 16 bp, Artificial sequence
  Primer
gtcattgacaccatct

SEQ ID NO: 339 - DNA, 19 bp, Artificial sequence
  Primer
agagataccgtaggtgttg

SEQ ID NO: 340 - DNA, 90 bp, Artificial sequence
  Primer
gtattttggtagattcaattctctttccctttccttttccttcgctccccttccttatcagcattgcggattacgtattctaatgttcag

SEQ ID NO: 341 - DNA, 90 bp, Artificial sequence
  Primer
ttggttgggggaaaaagaggcaacaggaaagatcagagggggagggggggggagagtgtcaccttggctaactcgttgtatcatcactgg

SEQ ID NO: 342 - DNA, 21 bp, Artificial sequence
  Primer
tcggtgcgggcctcttcgcta

SEQ ID NO: 343 - DNA, 21 bp, Artificial sequence
  Primer
aatgtgagttagctcactcat

SEQ ID NO: 344 - DNA, 33 bp, Artificial sequence
  Primer
aattggcgcgccatgaaagctctggtttatcac

SEQ ID NO: 345 - DNA, 49 bp, Artificial sequence
  Primer
tgaatcatgagttttatgttaattagctcaggcagcgcctgcgttcgag

SEQ ID NO: 346 - DNA, 49 bp, Artificial sequence
  Primer
atcctctcgaacgcaggcgctgcctgagctaattaacataaaactcatg

SEQ ID NO: 347 - DNA, 34 bp, Artificial sequence
  Primer
aattgtttaaacaagtaaataaattaatcagcat

SEQ ID NO: 348 - DNA, 49 bp, Artificial sequence
  Primer
acacaatacaataacaagaagaacaaaatgaaagctctggtttatcacg

SEQ ID NO: 349 - DNA, 49 bp, Artificial sequence
  Primer
agcgtatacatctgttgggaaagtagaaggccatgaagctttttctttc

SEQ ID NO: 350 - DNA, 49 bp, Artificial sequence
  Primer
ttggaaagaaaaagcttcatggccttctactttcccaacagatgtatac

SEQ ID NO: 351 - DNA, 22 bp, Artificial sequence
  Primer
ttattgtttagcgttagtagcg

SEQ ID NO: 352 - DNA, 72 bp, Artificial sequence
  Primer
cataatcaatctcaaagagaacaacacaatacaataacaagaagaacaaaatgaaagctctggtttatcacg

SEQ ID NO: 353 - DNA, 21 bp, Artificial sequence
  Primer
taggcataatcaccgaagaag

SEQ ID NO: 354 - DNA, 21 bp, Artificial sequence
  Primer
aaaatggtaagcagctgaaag

SEQ ID NO: 355 - DNA, 17 bp, Artificial sequence
  Primer
agttgttagaactgttg

SEQ ID NO: 356 - DNA, 19 bp, Artificial sequence
  Primer
gacgatagcgtatacatct

SEQ ID NO: 357 - DNA, 22 bp, Artificial sequence
  Primer
cttagcctctagccatagccat

SEQ ID NO: 358 - DNA, 23 bp, Artificial sequence
  Primer
ttagttttgctggccgcatcttc

SEQ ID NO: 359 - DNA, 15456 bp, Artificial sequence
  Template
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 360 - DNA, 1559 bp, Artificial sequence
  Template
gcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtg

SEQ ID NO: 361 - DNA, 1685 bp, Artificial sequence
  Cassette
gtattttggtagattcaattctctttccctttccttttccttcgctccccttccttatcagcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgacactctccccccccctccccctctgatctttcctgttgcctctttttcccccaaccaa

SEQ ID NO: 362 - DNA, 21 bp, Artificial sequence
  Primer oBP591
cccattaatatactattgaga

SEQ ID NO: 363 - DNA, 20 bp, Artificial sequence
  primer N98SeqF1
cgtgttagtcacatcaggac

SEQ ID NO: 364 - DNA, 20 bp, Artificial sequence
  primer N98SeqF4
ggtttctgtctctggtgacg

SEQ ID NO: 365 - DNA, 22 bp, Artificial sequence
  primer N99SeqR2
catcgactgcattacgcaactc

SEQ ID NO: 366 - DNA, 30 bp, Artificial sequence
  primer N1111
tatttgtatcgaggtgtctagtcttctatt

SEQ ID NO: 367 - DNA, 30 bp, Artificial sequence; identical to SEQ ID NO: 289
  primer N1110

SEQ ID NO: 368 - DNA, 38 bp, Artificial sequence; identical to SEQ ID NO: 292
  BK468 Primer

SEQ ID NO: 369 - DNA, 7589 bp, Artificial sequence
  pUC19-kan::pdc1::FBA-alsS::TRX1
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 370 - DNA, 38 bp, Artificial sequence
  primer N191
atccgcggatagatctcccattaccgacatttgggcgc

SEQ ID NO: 371 - DNA, 9593 bp, Artificial sequence
  Plasmid pYZ090DalsS
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 372 - DNA, 22 bp, Artificial sequence
  primer oBP556
tattttcgaggaccttgtcacc

SEQ ID NO: 373 - DNA, 25 bp, Artificial sequence
  oBP561
tggccattaatctttcccatattag

SEQ ID NO: 374 - DNA, 13114 bp, artificial sequence
  constructed plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgccgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgacgtcagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacatgtttaaactttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 375 - DNA, 987 bp, Enterococcus gallinarum
atggttaaggtctactacaacgaagttactgacaacttgggtgacaagactatcgctatcatcggttacggttctcaaggtcacgcccacgctcaaaacttgagagacaccggtcataatgttgtcatcggtatcagagctggtaaatctgccgaaaacgctaagaacgatggtttcactgttttgccagtctccgaagctgttcaacaggccaacgttgtcatgatcttggctccagacgaaattcagggtgaattgtacgaaaaggaaatcgctccaaacttgtctgctggtgacgctttagccttcgctcacggtttcaacatccatttcgaagtcattaccccaccaaaagaagttgacgttttcttggttgctccaaagggtccaggtcacttggtcagacgtaccttctctgaaggtttcgccgttccagctttgttcgccgtctaccaagatgctaccggtaacgcccaggaaactgctttgtcctacgccaagggtatcggtgctaccagagttggtgtcttggaaaccaccttcaaggaagaaaccgaaaccgacttgttcggtgaacaagctgttttgtgtggtggtctgacttctatgattgaaaccggtttcgaaactctggtcgaagctggttaccaaccagaattggcctacttcgaagtttgccacgaaatgaagttgatcgtcgatttgatctacgaaggtggtttcgctaagatgagagactctatctccaacaccgccgaatacggtgactacgtttctggttctagaatcattaccgaacaaactaaggctaacatgaaaaatgtcttgaaggacatccagaacggtacctttgctaagggtttcattgctgataaccaagccggtttcccagaattcaagaagatgagagaacagaacggtaatcacccaatcgaaaaggtcggttctgaattgagaaagatgatgccattcgttactaaggactga

SEQ ID NO: 376 - protein, 328 aa, Enterococcus gallinarum; identical to SEQ ID NO: 87

SEQ ID NO: 377 - DNA, 1023 bp, Lactococcus lactis
atggctgtcactatgtactacgaagaagacgttgaagtcgccgccttggccggtaagaagatcgccgttatcggttacggttcccaaggtcacgctcatgcccaaaacttgagagactctggtcacgatgttatcattggtgttagacagggtaaatctttcgacaaggctaaagaagatggtttcgaaacctttgaagttggtgaagctgtcgccaaggctgacgttatcatggtcttggctccagatgaattgcaacagtctatctacgaagaagacattaagccaaacttgaaggctggttctgctttgggtttcgctcacggtttcaacatccatttcggttacattgaagttccagaagacgttgatgtcttcatggtcgccccaaaggctccaggtcacttggttagacgtaccttcaccgaaggtttcggtaccccagctttgttcgtctctcaccaaaacgccactggtcatgctagagaaatcgccatggactgggctaagggtattggttgtgctagagttggtatcattgaaaccactttcaaggaagaaaccgaagaagatttgttcggtgaacaagctgtcctgtgcggtggtttaactgccttggttgaagctggtttcgaaaccttgactgaagccggttacgctggtgaattggcttacttcgaagttttacacgaaatgaagttgatcgttgacttgatgtacgaaggtggtttcaccaagatgagacaatctatttccaacactgctgaattcggtgactacgtcaccggtccaagaatcatcactgatgaagttaagaagaacatgaagttggtcctggccgacatccaatccggtaaatttgctcaggatttcgttgacgattttaaggccggtagaccaaagttgaccgcttaccgtgaagctgccaagaacttggaaatcgaaaagatcggtgctgaattgagaaaggctatgccattcacccaatccggtgacgacgacgctttcaagatttaccaataa

SEQ ID NO: 378 - protein, 340 aa, Lactococcus lactis; identical to SEQ ID NO: 101

SEQ ID NO: 379 - DNA, 1023 bp, Lactococcus lactis
atggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaa

SEQ ID NO: 380 - protein, 340 aa, Lactococcus lactis; identical to SEQ ID NO: 133

SEQ ID NO: 381 - DNA, 1023 bp, Streptococcus thermophilus
atggccgttcaaatggaatacgaaaaggacgttaaggtcccagccttggatggtaagaagatcgccgttatcggttacggttctcaaggtcacgctcattctcaaaacttgagagacaccggtcacgatgttatcattggtgttagaccaggtaaatctttcgacaaggctaaagaagacggttttgatacctacactgtcgctgaagccactaagttggccgacgttatcatgattttggctccagatgaaatccaacaggaattgtacgaagctgaaattgccccaaacttggaagctggtaatgccgtcggtttcgctcacggtttcaacatccatttcgaattcatcaaggttccagccgacgttgatgtcttcatgtgtgctccaaagggtccaggtcacttggtcagacgtaccttcgaagaaggttttggtgtcccagctttgtacgccgtttaccaagatgctactggtaacgccaaggacatcgctatggattggtgtaaaggtattggtgctgccagagttggtttgttggaaaccacttacaaggaagaaaccgaagaagacttgttcggtgaacaggctgtcttatgcggtggtttaaccgctttgatcgaaactggtttcgaagttttgactgaagctggttacgccccagaattggcttacttcgaagtcctgcacgaaatgaagttgatcgttgacttgatctacgaaggtggtttcaagaagatgagacaatctatctccaacaccgctgaattcggtgactacgtttctggtccaagagtcatcactgaacaagttaaggaaaacatgaaggctgttttggctgacattcagaatggtaaattcgctaacgacttcgttaacgattacaaggccggtagaccaaagttgaccgcttaccgtgaagaagctgccaacttggaaatcgaaaaggtcggtgctgaattgagaaaggctatgccattcgttggtcaaaacgacgacgacgctttcaagatttacaactga

SEQ ID NO: 382 - protein, 340 aa, Streptococcus thermophilus; identical to SEQ ID NO: 121

SEQ ID NO: 383 - DNA, 11017 bp, Artificial sequence
  pRS426::GPD-xpk1+ADH-eutD
gatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcggatagatctagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacgctgaggatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataattaattaatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaattaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatcctcagcgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaag

SEQ ID NO: 384 - DNA, 1862 bp, Artificial sequence
  1.8kb KpnI-HincII geneticin resistant cassette
gtcgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcgggtacc

SEQ ID NO: 385 - DNA, 7938 bp, Artificial sequence
  YZ067DkivDDhADH
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 386 - DNA, 4586 bp, Artificial sequence
  pLA54 template DNA
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 387 - DNA, 7589 bp, Artificial sequence; identical to SEQ ID NO: 369
  pUC19-kan::pdc1::FBA-alsS::TRX1

SEQ ID NO: 388 - DNA, 19 bp, Artificial sequence
  N160SeqR5 primer
tgagcccgaaagagaggat

SEQ ID NO: 389 - protein, 338 aa, Artificial sequence
  k9_Grace_SH
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDDGSQVHFKAMRKLASEHPAEVVGEEIRSLYSWSDEDKLINN

SEQ ID NO: 390 - DNA, 24 bp, Artificial sequence
  primer K9G9_EZ_F1
aaacatggaagaatgtaagatggc

SEQ ID NO: 391 - DNA, 25 bp, Artificial sequence
  Primer K9G9_EZ_R1
tcagttgttaatcaacttgtcttcg

SEQ ID NO: 392 - DNA, 9613 bp, Artificial sequence
  pHR81-PIlv5-KARI-K9.G9
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcgaaggagtggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 393 - DNA, 20 bp, Artificial sequence
  Primer pBAD-For
atgccatagcatttttatcc

SEQ ID NO: 394 - DNA, 22 bp, Artificial sequence
  Primer pBAD-Rev
ctgatttaatctgtatcaggct

SEQ ID NO: 395 - DNA, 50 bp, Artificial sequence
  Primer N87PC1
ctgacatcattatgatcttgatcccagatgaaaagcaggctaccatgtac

SEQ ID NO: 396 - DNA, 50 bp, Artificial sequence
  Primer N87PC1r
gtacatggtagcctgcttttcatctgggatcaagatcataatgatgtcag

SEQ ID NO: 397 - DNA, 37 bp, Artificial sequence
  Primer oK57E1
ggtttattcgaaggtgcggaggagtggaaaagagctg

SEQ ID NO: 398 - DNA, 37 bp, Artificial sequence
  Primer oK57E1r
cagctcttttccactcctccgcaccttcgaataaacc

SEQ ID NO: 399 - DNA, 38 bp, Artificial sequence
  Primer oY53F1
gtaacgttatcattggtttatacgaaggtgcggaggag

SEQ ID NO: 400 - DNA, 38 bp, Artificial sequence
  Primer oY53F1r
ctcctccgcaccttcgaataaaccaatgataacgttac

SEQ ID NO: 401 - DNA, 43 bp, Artificial sequence
  Primer oK90L1
gatcttgatcccagatgaattgcaggctaccatgtacaaaaac

SEQ ID NO: 402 - DNA, 42 bp, Artificial sequence
  Primer oK90L1r
gtttttgtacatggtagcctgcaattcatctgggatcaagat

SEQ ID NO: 403 - DNA, 40 bp, Artificial sequence
  Primer oK90M1
cttgatcccagatgaaatgcaggctaccatgtacaaaaac

SEQ ID NO: 404 - DNA, 40 bp, Artificial sequence
  Primer oK90M1r
gtttttgtacatggtagcctgcatttcatctgggatcaag

SEQ ID NO: 405 - protein, 338 aa, Artificial sequence
  K9_Ingrid_SH
MAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQIHFKAMRKLASEHPAEVVGEEIRSLYSWSDEDKLINN

SEQ ID NO: 406 - DNA, 719 bp, Artificial sequence
  Promoter UAS(PGK1)-PFBA1
aattaccgtcgctcgtgatttgtttgcaaaaagaacaaaactgaaaaaacccagacacgctcgacttcctgtcttcctattgattgcagcttccaatttcgtcacacaacaaggtcctgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 407 - DNA, 36 bp, Artificial sequence
  Primer oBP821
aattgtttaaactaagcgaatttcttatgatttatg

SEQ ID NO: 408 - DNA, 34 bp, Artificial sequence; identical to SEQ ID NO: 200
  Primer oBP484

SEQ ID NO: 409 - DNA, 37 bp, Artificial sequence
  Primer oBP822
aattgcggccgcgtgcctcatctatatttctgaaatc

SEQ ID NO: 410 - DNA, 37 bp, Artificial sequence
  Primer oBP823
aattttaattaatcagctcttgttttgttctgcaaat

SEQ ID NO: 411 - DNA, 1647 bp, Artificial sequence
  Listeria grayi ketoisovalerate decarboxylase coding sequence--codon optimized for expression in Saccharomyces cerevisiae
atgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaa

SEQ ID NO: 412 - DNA, 36 bp, Artificial sequence
  Primer oBP828
aattgtttaaacatgtataccgtaggacagtacttg

SEQ ID NO: 413 - DNA, 35 bp, Artificial sequence
  oBP829
aattgtttaaacttaagagttttgcttagataagg

SEQ ID NO: 414 - DNA, 29 bp, Artificial sequence
  Primer FBAp-F
ctacaatcaacagatcgcttcaattacgc

SEQ ID NO: 415 - DNA, 29 bp, Artificial sequence
  Primer HY-50
gagagttcactgtttaacaatagcaatgg

SEQ ID NO: 416 - DNA, 26 bp, Artificial sequence
  Primer oBP834
tgctgatactgctgctaaacaagctg

SEQ ID NO: 417 - protein, 343 aa, Artificial sequence
  Anaerostipes KARI variant-K9JB4
MEECKMAKIYYQEDCNLSLLDGKTIAVIGYGSQGHAHALNAKESGCNVIIGLYEGAEEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 418 - DNA, 1032 bp, Artificial sequence
  coding sequence for Anaerostipes KARI variant-K9JB4
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 419 - protein, 343 aa, Artificial sequence
  Anaerostipes KARI variant-K9JB4P
MEECKMAKIYYQEDCNLSLLDGKTIAVIGYGSQGHAHALNAKESGCNVIIGLYEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 420 - DNA, 1032 bp, Artificial sequence
  coding sequence for Anaerostipes KARI variant K9JB4P
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 421 - protein, 343 aa, Artificial sequence
  Anaerostipes caccae KARI variant-K9JG3
MEECKMAKIYYQEDCNLSLLDGKTIAVIGYGSQGHAHALNAKESGCNVIIGLFEGAKEWKRAEEQGFEVYTAAGAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 422 - DNA, 1032 bp, Artificial sequence
  coding sequence for Anaerostipes caccae KARI variant K9JG3
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcgaaggagtggaaaagagctgaagaacaaggtttcgaagtctacaccgctgctggagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 423 - protein, 343 aa, Artificial sequence
  Anaerostipes caccae KARI variant-K9JG3P
MEECKMAKIYYQEDCNLSLLDGKTIAVIGYGSQGHAHALNAKESGCNVIIGLFEGAKEWKRAEEQGFEVYTAAGAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 424 - DNA, 1032 bp, Artificial sequence
  coding sequence for Anaerostipes caccae KARI variant-K9JG3P
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcgaaggagtggaaaagagctgaagaacaaggtttcgaagtctacaccgctgctggagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 425 - protein, 343 aa, Artificial sequence
  Anaerostipes caccae KARI variant-K9JA1
MEECKMAKIYYQEDCNLSLLDGKTIAVIGYGSQGHAHALNAKESGCNVIIGLFEGAEEWKRAEEQGFEVYTAAGAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 426 - DNA, 1032 bp, Artificial sequence
  coding sequence for Anaerostipes caccae KARI variant K9JA1
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctggagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 427 - protein, 343 aa, Artificial sequence
  Anaerostipes caccae KARI variant- K9SB2
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 428 - DNA, 1032 bp, Artificial sequence
  Anaerostipes caccae KARI variant-K9SB2
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 429 - protein, 343 aa, Artificial sequence
  Anaerostipes caccae KARI variant-K9SB2-K90L
MEECKMAKIYYQEDCNLSLLDGKTIAVIGYGSQGHAHALNAKESGCNVIIGLFEGAEEWKRAEEQGFEVYTAAEAAKKADIIMILIPDELQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 430 - DNA, 1032 bp, Artificial sequence
  coding sequence for Anaerostipes KARI variant K9SB2-K90L
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaattgcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 431 - protein, 343 aa, Artificial sequence
  Anaerostipes caccae KARI variant-K9SB2-K90M
MEECKMAKIYYQEDCNLSLLDGKTIAVIGYGSQGHAHALNAKESGCNVIIGLFEGAEEWKRAEEQGFEVYTAAEAAKKADIIMILIPDEMQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 432 - DNA, 1032 bp, Artificial sequence
  coding sequence for Anaerostipes caccae KARI variant-K9SB2-K90M
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaatgcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 433 - protein, 343 aa, Artificial sequence
  Anaerostipes caccae KARI variant- 2011_A2
MEECKMAKIYYQEDCNLSLLDGKTIAVIGYGSQGHAHALNAKESGCNVIIGLFEDAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 434 - protein, 343 aa, Artificial sequence
  Anaerostipes caccae KARI variant-2011_A3
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 435 - protein, 343 aa, Artificial sequence
  Anaerostipes caccae KARI variant-2011_A5
MEECKMAKIYYQEDCNLSLLDGKTIAVIGYGSQGNAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 436 - protein, 343 aa, Artificial sequence
  Anaerostipes caccae KARI variant 2011_A7
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNVIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 437 - protein, 343 aa, Artificial sequence
  Anaerostipes caccae KARI variant-2011_A9
MEECKMAKIYYQEDCNLSLLDGKTIAVIGYGSQGHAHALNAKESGCNVIIGLFEGAEEWKRAEEQGIEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 438 - protein, 343 aa, Artificial sequence
  Anaerostipes caccae KARI variant-2011_A11
MEECKMAKIYYQEDCNLSLLDGKTIAVIGYGSQGHAHALNAKESGCNVIIGLFEGAEEWKRAEEQGFEVYTAAEAAKKADIIMILIPDEKQATTYKNDIEPNLEAGNMLMFAHGFNIHFGCIVPPEDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIIAEDTKKAMKKILSDIQDGTFAKDFLVDMSDAGSQVHFKAMRKLASEHPAEVVGEEIRSLYSWSDEDKLINN

SEQ ID NO: 439 - protein, 343 aa, Artificial sequence
  Anaerostipes caccae KARI variant-2011_B1
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKTMKKILSDIQDGTFAKDFLVDMSDAGSQVHFKAMRKLASEHPAEVVGEEIRSLYSWSDEDKLINN

SEQ ID NO: 440 - protein, 343 aa, Artificial sequence
  Anaerostipes caccae KARI variant-2011_B2
MEECKMAKIYYQEDCNLSLLDGKTIAVIGYGSQGHAHALNAKESGCNVIIGLFEGAEEWKRAEEQGFEVYTAAEAAKKADIIMILIPDEKLATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 441 - protein, 343 aa, Artificial sequence
  Anaerostipes caccae KARI variant-2011_B3
MEECKMAKIYYQEDCNLSLLDGKTIAVIGYGSQGHAHALNAKESGCNVIIGLLEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 442 - protein, 343 aa, Artificial sequence
  Anaerostipes caccae KARI variant-2011_B4
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIATKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 443 - protein, 343 aa, Artificial sequence
  Anaerostipes caccae KARI variant-2011_B7
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVMETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 444 - protein, 343 aa, Artificial sequence
  Anaerostipes caccae KARI variant-2011_B8
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFESIHEMKLIVDLIYQSGFSGMRYSISNTAEYGDYITGPKIITEDTKKAMKKILSDIQDGTFAKDYLVDMSDAGSQVHFKAMRKLASEHPAEVVGEEIRSLYSWSDEDKLINN

SEQ ID NO: 445 - protein, 343 aa, Artificial sequence
  Anaerostipes caccae KARI variant-2011_B10
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDDGSQVHFKAMRKLASEHPAEVVGEEIRSLYSWSDEDKLINN

SEQ ID NO: 446 - protein, 343 aa, Artificial sequence
  Anaerostipes caccae KARI variant-2011_C1
MEECKMAKIYYQEDCNLSLLDGKTIAVIGYGSQGHAHALNAKESGCNVIIGLFEGAEEWKRAKEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSDMRYSISNTAEYGDYITGPKIITEDTKKAMKKILSDIQDGTFARDFLVDMSDAGSQVHFKAMRKLASEHPAEVVGEEIRSLYSWSDEDKLINN

SEQ ID NO: 447 - protein, 343 aa, Artificial sequence
  Anaerostipes caccae KARI variant 2011_C9
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETDTDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 448 - protein, 343 aa, Artificial sequence
  Anaerostipes caccae KARI variant-2011_C3
MEECKMAKIYYQEDCNLSLLDGKTIAVIGYGSQGHAHALNAKESGCNVIIGLFEGAEEWKRAEEQGFEVYTVAEAAKKADIIMILIPDEKQATMYKNDIEPYLEAGNMLMFAHGFNIHFGCIVPPKDVDVTMIAPKGPGHTVRSEYEEGKGVPCLVAVEQDATGKALDMALAYALAIGGARAGVLETTIRTETETDLFGEQAVLCGGVCALMQAGFETLVEAGYDPRNAYFECIHEMKLIVDLIHQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 449 - protein, 343 aa, Artificial sequence
  Anaerostipes caccae KARI variant-2011_C6
MEECKMAKIYYQEDCNLSLLDGKTIAVIGYGSQGHAHALNAKESGCNVIIGLFEGAEEWKRAEEQGFEVYTAAEAAKKADIIMFLIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 450 - protein, 343 aa, Artificial sequence
  Anaerostipes caccae KARI variant-2011_C7
MEECKMAKIYYQVDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHIVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 451 - protein, 343 aa, Artificial sequence; identical to SEQ ID NO: 448
  Anaerostipes caccae KARI variant-2011_C8

SEQ ID NO: 452 - protein, 343 aa, Artificial sequence
  Anaerostipes caccae KARI variant-2011_C10
MEECKMAKIYYQEDCNLSLLDGKTIAVIGYGSQGHAHALNAKESGCNVIIGLFEGGEEWNRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 453 - protein, 343 aa, Artificial sequence
  Anaerostipes caccae KARI variant-2011_C12
MEECKMAKIYYQEDCNLSLLDGKTIAVIGYGSQGHAHALNAKESGCNVIIGLFEGAEEWKRAEEQGFEVYTAAEAAKKADIIMLLIPDEKQATMYKTDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 454 - protein, 343 aa, Artificial sequence
  Anaerostipes caccae KARI variant-2011_D1
MEECKMAKIYYQEDCNLSLLDGKTIAVIGYGSQGHAHAMNAKESGCNVIIGLFEGAEEWKRAEEQGFGVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 455 - protein, 343 aa, Artificial sequence
  Anaerostipes caccae KARI variant-2011_D2
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQIHFKAMRKLASEHPAEVVGEEIRSLYSWSDEDKLINN

SEQ ID NO: 456 - protein, 343 aa, Artificial sequence; identical to SEQ ID NO: 437
  Anaerostipes caccae KARI variant-2011_D3

SEQ ID NO: 457 - protein, 343 aa, Artificial sequence
  Anaerostipes caccae KARI variant-2011_D4
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIALKGPGHTVRSEYEEGKGVPCLVAVEQDATGKALDMALAYALAIGGARAGVLETTFRTETETDLFGEQVVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 458 - protein, 343 aa, Artificial sequence
  Anaerostipes caccae KARI variant-2011_D5
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATSKALDMALAYALAIGGARAGVLETTFRTETETDLFAEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 459 - protein, 343 aa, Artificial sequence
  Anaerostipes caccae KARI variant-2011_D8
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFTIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 460 - protein, 343 aa, Artificial sequence; identical to SEQ ID NO: 431
  Anaerostipes caccae KARI variant-2011_D9

SEQ ID NO: 461 - protein, 343 aa, Artificial sequence
  Anaerostipes caccae KARI variant-2011_D11
MEECKMAKIYYQEDCNLSLLDGKTIAVIGYGSQGHAHALNAKESGCNVIIGLFEGAEEWKRAEEQGFEVYTAAEAAKKADIIMILIPDEKQATLYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNIAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 462 - protein, 343 aa, Artificial sequence
  Anaerostipes caccae KARI variant-2011_D12
MEECKMAKIYYQEDCNLSLLDGKTIAVIGYGSQGHAHALNAKESGCNVIIGLFEGAEEWKRAEEQGFEVYTAAEAAKKADIIKILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 463 - protein, 343 aa, Artificial sequence
  Anaerostipes caccae KARI variant-2011_E3
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCVVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFWVDMSDAGSQVHFKAMRKLASEHPAEVVGEEIRSLYSWSDEDKLINN

SEQ ID NO: 464 - protein, 343 aa, Artificial sequence
  Anaerostipes caccae KARI variant-2011_E4
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFSHGFNIHFGCIVPPKDVDVTMIAPKGPGHTVRSEYEEGKGVPCLVAVERDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 465 - protein, 343 aa, Artificial sequence
  Anaerostipes caccae KARI variant-2011_E8
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTIRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHLAEVVGEEIRSLYSWSDEDKLINN

SEQ ID NO: 466 - protein, 343 aa, Artificial sequence; identical to SEQ ID NO: 440
  Anaerostipes caccae KARI variant-2011_E11

SEQ ID NO: 467 - protein, 343 aa, Artificial sequence
  Anaerostipes caccae KARI variant-2011_F2
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCTLMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 468 - protein, 343 aa, Artificial sequence
  Anaerostipes caccae KARI variant-2011_F4
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTIRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 469 - protein, 343 aa, Artificial sequence; identical to SEQ ID NO: 452
  Anaerostipes caccae KARI variant-2011_F6

SEQ ID NO: 470 - protein, 343 aa, Artificial sequence
  Anaerostipes caccae KARI variant-2011_F9
MEECKMAKIYYQEDCNLSLLDGKTIAVIGYGSQGHAHALNVKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGPQVHFKAMRKLASEHPAEVVGEEIRSLYSWSDEDKLINN

SEQ ID NO: 471 - protein, 343 aa, Artificial sequence
  Anaerostipes caccae KARI variant-2011_F10
MEECKMAKIYYQEDCNLSLLDGKTIAVIGYGSQGHAHALNAKESGCNVIIGLFEGAEEWKRAEEQGFEVYTAAEAAKKADIIMIMIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 472 - protein, 343 aa, Artificial sequence; identical to SEQ ID NO: 450
  Anaerostipes caccae KARI variant-2011_G1

SEQ ID NO: 473 - protein, 343 aa, Artificial sequence
  Anaerostipes caccae KARI variant-2011_G3
MEECKMAKIYYQEDCNLSLLDGKTIAVIGYGSQGQAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 474 - protein, 343 aa, Artificial sequence; identical to SEQ ID NO: 449
  Anaerostipes caccae KARI variant-2011_G4

SEQ ID NO: 475 - protein, 343 aa, Artificial sequence
  Anaerostipes caccae KARI variant-2011_G8
MEECKMAKIYYQEDCNLSLLDGKTIAVIGYGSQGHAHALNAKESGCNVIIGLFEGAEEWKRAEEQGFEVYTAAEAANKADIIMILIPDEKQVTMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 476 - protein, 343 aa, Artificial sequence
  Anaerostipes caccae KARI variant-2011_G9
MEECKMAKIYYQEDCNLSLLDGKTIAVIGYGSQGHAHALNAKESGCNVIIGLFEGTEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 477 - protein, 343 aa, Artificial sequence; identical to SEQ ID NO: 449
  Anaerostipes caccae KARI variant-2011_G10

SEQ ID NO: 478 - protein, 343 aa, Artificial sequence
  Anaerostipes caccae KARI variant-2011_H1
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLLAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 479 - protein, 343 aa, Artificial sequence
  Anaerostipes caccae KARI variant-2011_H5
MEECKMAKIYYQEDCNLSLLDGKTIAVIGYGSQGHAHALNAKESGCNVIIGLFEGAEEWKRAEEQGFEVYTAAEAAKKADIIMLLIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 480 - protein, 343 aa, Artificial sequence; identical to SEQ ID NO: 476
  Anaerostipes caccae KARI variant-2011_H7

SEQ ID NO: 481 - protein, 343 aa, Artificial sequence
  Anaerostipes caccae KARI variant-2011_H9
MEECKMAKIYYQEDCNLSLLDGKTIAVIGYGSQGHAHALNAKESGCNVIIGLFECAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 482 - protein, 343 aa, Artificial sequence
  Anaerostipes caccae KARI variant-2012_A2
MEECKMAKIYYQEDCNLSLLDGKTIAVIGYGSQGHAHALNAKESGCNVIIGLFEGAEEWKGAEEQGFEVYTAAEAAKKADIIMILVPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 483 - protein, 343 aa, Artificial sequence
  Anaerostipes caccae KARI variant-2012_A7
MEECKMAKIYYQEDCNLSLLDGKTIAVIGYGSQGHAHALNAKESGCNVIIGLFEGAEEWKRAEEQGFEVYSAAEAVKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 484 - protein, 343 aa, Artificial sequence
  Anaerostipes caccae KARI variant-2012_A8
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALTQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 485 - protein, 343 aa, Artificial sequence
  Anaerostipes caccae KARI variant-2012_A9
MEECKMAKIYYQEDCNLSLLDGKTIAVIGYGSQGQAHALNAKESGCNVIIGLFEGAEEWKRAEEQGFEVYTTAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 486 - protein, 343 aa, Artificial sequence
  Anaerostipes caccae KARI variant-2012_A10
MEECKMAKIYYQEDCNLSLLDGKTIAVIGYGSQGHTHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 487 - protein, 343 aa, Artificial sequence
  Anaerostipes caccae KARI variant-2012_A11
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQTGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 488 - protein, 343 aa, Artificial sequence
  Anaerostipes caccae KARI variant-2012_B3
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIASKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 489 - protein, 343 aa, Artificial sequence
  Anaerostipes caccae KARI variant-2012_B4
MEECKMAKIYYQEDCNLSLLDGKTIAVIGYGSQGHAHALNAKESGCNVIIGLFEGAEERKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKEAMKKILSDIQDGTFAKDFLVDMSDAGSQVHFKAMRKLASEHPAEVVGEEIRSLYSWSDEDKLINN

SEQ ID NO: 490 - protein, 343 aa, Artificial sequence
  Anaerostipes caccae KARI variant-2012_B5
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECVHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 491 - protein, 343 aa, Artificial sequence
  Anaerostipes caccae KARI variant-2012_B6
MEECKMAKIYYQEDCNLSLLDGKTIAVIGHGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 492 - protein, 343 aa, Artificial sequence
  Anaerostipes caccae KARI variant-2012_B9
MEECKMAKIYYQEDCNLSLLDGKTIAVIGYGSQGHAHALNAKESGCNVIMGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 493 - protein, 343 aa, Artificial sequence; identical to SEQ ID NO: 441
  Anaerostipes caccae KARI variant-2012_C2

SEQ ID NO: 494 - protein, 343 aa, Artificial sequence
  Anaerostipes caccae KARI variant-2012_C3
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGVNIHFGCIVPPKDVDVTMIAPKGPGHTVRSEYEEGKGVPCLVAVEQDATGKALDMALAYALAIGGARAGVLETTFRSETETDLFGEQAVLCGGIWALMQAGFETLVEAGYDPRNAYFECIHEMKLIVDLIYQSGFSGMRYSISNTAEYGDYITGPKIITEDTKKAMKKILSDIQDGTIAKDFLVDMSDAGSQVHFKAMRKLASEHPAEVVGEEIRSLYSWSDEDKLINN

SEQ ID NO: 495 - protein, 343 aa, Artificial sequence; identical to SEQ ID NO: 434
  Anaerostipes caccae KARI variant-2012_C5

SEQ ID NO: 496 - protein, 343 aa, Artificial sequence
  Anaerostipes caccae KARI variant
MEECKMAKIYYQEDCNLSLLDGKTIAVIGYGSQGHAHALNAKESGCNVIIGLFEGAEEWKRAEEQGLEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 497 - protein, 343 aa, Artificial sequence
  Anaerostipes caccae KARI variant-2012_C8
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDTALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 498 - protein, 343 aa, Artificial sequence
  Anaerostipes caccae KARI variant-2012_C10
MEECKMAKIYYQEDCNLSLLDGKTIAVIGYGSQGHAHALNAKESGCNVIIGLFEGAEEWKRAEEQGIEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDIKKAMKKILSDIQDGTFAKDFLVDMSDAGSQVHFKAMRKLASEHPAEVVGEEIRSLYSWSDEDKLINN

SEQ ID NO: 499 - protein, 343 aa, Artificial sequence
  Anaerostipes caccae KARI variant-2012_D1
MEECKMAKIYYQEDCNLSLLDGKTIAVIGYGSQGHAHALNAKESGCNVIIGLFEGAEEWKRAEEQGFEVYTAAEAAKKADIIMFLIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKATRKLASEHPAEVVGEEIRSLYSWSDEDKLINN

SEQ ID NO: 500 - protein, 343 aa, Artificial sequence
  Anaerostipes caccae KARI variant D6_2011
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQCGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 501 - protein, 343 aa, Artificial sequence; identical to SEQ ID NO: 488
  Anaerostipes caccae KARI variant-2012_D8

SEQ ID NO: 502 - protein, 343 aa, Artificial sequence
  Anaerostipes caccae KARI variant-2012_D11
MEECKMANIYYQEDCNLSLLDGKTIAVIGYGSQGHAHALNAKESGCNVIIGLFEGAEEWKRAEEQGFEVYTAAEAAKKADIIMILIPDEMQATMYKNDIEPNLEAGNMLMFAHGFNIHFGCIVPPKDVDVTMIAPKGPGHIVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 503 - protein, 343 aa, Artificial sequence; identical to SEQ ID NO: 479
  Anaerostipes caccae KARI variant-2012_E5

SEQ ID NO: 504 - protein, 343 aa, Artificial sequence
  Anaerostipes caccae KARI variant-2012_E9
MEECKMAKIYYQEDCNLSLLDGKTIAVIGYGSQGHAHALNAKESGCNVIIGLFEGAEEWKRAEEQGFEVYTAAEAAKKADIIIILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVMETTFRTETETDLFGEQAVLCGGVCALMQAGFDTLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 505 - protein, 343 aa, Artificial sequence
  Anaerostipes caccae KARI variant-2012_F1
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIYEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 506 - protein, 343 aa, Artificial sequence
  Anaerostipes caccae KARI variant-2012_F2
MEECKMAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEDVGEEIRSLYSWSDEDKLINN

SEQ ID NO: 507 - protein, 343 aa, Artificial sequence
  Anaerostipes caccae KARI variant-2012_F3
MEECKMAKIYYQEDCNLSLLDGKTIAVIGYGSQGHAHALNAKESGCNVIIGLFEGAEEWKRAEEQGFEVYTAAEAAKKADIIMILIPDEMQATMYKNDIEPNLEAGNMLMFAHGFNIHFGCIVPPKDVDVTMIAPKGPGHTIRSEYEEGKGVPCLVAVEQDATGKALDMALAYALAIGGARAGVLESTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 508 - protein, 343 aa, Artificial sequence
  Anaerostipes caccae KARI variant-2012_F4
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEDKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 509 - protein, 343 aa, Artificial sequence; identical to SEQ ID NO: 450
  Anaerostipes caccae KARI variant-2012_F7

SEQ ID NO: 510 - protein, 343 aa, Artificial sequence
  Anaerostipes caccae KARI variant-2012_F10
MEECKMAKIYYQEDCNLSLLDGKTIAVIGYGSQGHAHALNAKESGCNVIIGLFEGAEEWKRAEEHGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTIRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 511 - protein, 343 aa, Artificial sequence [sequence omitted]

SEQ ID NO: 512 - protein, 343 aa, Artificial sequence
  Anaerostipes caccae KARI variant-2012_G3
MEECKMAKIYYQEDCNLSLLDGKTIAVIGYGSQGHAHALNAKESGCNVIIGLFEGTEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFSTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 513 - protein, 343 aa, Artificial sequence
  Anaerostipes caccae KARI variant-2012_G4
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPSLEAGNMLMFAHGFNIHFGCIVPPKDVDVTMIAPKGPGHTIRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 514 - protein, 343 aa, Artificial sequence; identical to SEQ ID NO: 479
  Anaerostipes caccae KARI variant-2012_G5

SEQ ID NO: 515 - protein, 343 aa, Artificial sequence
  Anaerostipes caccae KARI variant-2012_G8
MEECKMAKIYYQEDCNLSLLDGKTIAVIGYGSQGHAHALNAKESGCNVIIGLFEGAEEWKRAEEQGFEVYTTAEAANKADIIMILIPDEKQVTMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCAMMQAGFETLVEAGYDPRNAYFECIHEMKLMVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 516 - protein, 343 aa, Artificial sequence; identical to SEQ ID NO: 455
  Anaerostipes caccae KARI variant-2012_G9

SEQ ID NO: 517 - protein, 343 aa, Artificial sequence
  Anaerostipes caccae KARI variant-2012_G10
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETEIDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 518 - protein, 343 aa, Artificial sequence
  Anaerostipes caccae KARI variant-2012_G12
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHIKAMRKLASEHPAEVVGEEIRSLYSWSDEDKLINN

SEQ ID NO: 519 - protein, 343 aa, Artificial sequence
  Anaerostipes caccae KARI variant-2012_H1
MEECKMAKIYYQEDCNLSLLDGKTIAVIGYGSQGHAHALNAKESGCNVIIGLFEGAEEWKRAEEQGFEVYTAAEAAKKADIIMILIPDETQATMYKNDIEPNLEAGNMLMFAHGFNIHFGCIVPPKDVDVTMIAPKGPGHTVRSEYEEGKGVPCLVAVEQDATGKALDMALAYALAIGGSRAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 520 - protein, 343 aa, Artificial sequence
  Anaerostipes caccae KARI variant-2012_H3
MEECKMAKIYYQEDCNLSLLDGKTIAVIGYGSQGHAHALNAKESGCNVIIGLFEGAEECKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 521 - protein, 343 aa, Artificial sequence
  Anaerostipes caccae KARI variant-2012_H7
MEECKMAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQTVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 522 - protein, 343 aa, Artificial sequence
  Anaerostipes caccae KARI variant
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTIRSEYEEGKGVPCLVAVEQDATGKALDMALAYALAIGGARAGVLETTFRSETETDLFGEQAVLCGGVCALMQAGFETLVEAGYDPRNAYFESIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 523 - protein, 343 aa, Artificial sequence
  Anaerostipes caccae KARI variant-2012_H11
MEECKMAKIYYQEDCNLSLLDGKTIAVIGYGSQGHAHALNAKESGCNVIIGLFEGAEEWKRAEEQGFEVYTVAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCAMMQAGFETLVEAGYDPRNAYFECIHEMKLMVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 524 - protein, 343 aa, Artificial sequence
  Anaerostipes caccae KARI variant-2013_A2
MEECKMAKIYYQEDCNLSLLDGKTIAVIGYGSQGHAHALNAKESGCNVIIGLFEGTEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIHDGTFAKDFLVDMSDAGSQVHFKAMRKLASEHPAEVVGEEIRSLYSWSDEDKLINN

SEQ ID NO: 525 - protein, 343 aa, Artificial sequence; identical to SEQ ID NO: 471
  Anaerostipes caccae KARI variant 2013_A4

SEQ ID NO: 526 - protein, 343 aa, Artificial sequence
  Anaerostipes caccae KARI variant-2013_A5
MEECKMAKIYYQEDCNLSLLDGKTIAVIGYGSQGHAHALNAKESGCNVIIGSFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 527 - protein, 343 aa, Artificial sequence
  Anaerostipes caccae KARI variant-2013_B2
MEECKMAKIYYQEDCNLSLLDGKTIAVIGYGSQGHTHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAILCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 528 - protein, 343 aa, Artificial sequence; identical to SEQ ID NO: 442
  Anaerostipes caccae KARI variant-2013_B5

SEQ ID NO: 529 - protein, 343 aa, Artificial sequence
  Anaerostipes caccae KARI variant-2013_B7
MEECKMAKMYYQEDCNLSLLDGKTIAVIGYGSQGHAHALNAKESGCNVIIGLFEGAEEWKRAEEQGFEVYTAAEAAKKADIIMILIPDEEQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 530 - protein, 343 aa, Artificial sequence; identical to SEQ ID NO: 481
  Anaerostipes caccae KARI variant-2013_B8

SEQ ID NO: 531 - protein, 343 aa, Artificial sequence [sequence omitted]

SEQ ID NO: 532 - protein, 343 aa, Artificial sequence
  Anaerostipes caccae KARI variant-2013_B11
MEECKMAKIYYQEDCNLSLLDGKTIAVIGYGSQGHAHVLNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 533 - protein, 343 aa, Artificial sequence
  Anaerostipes caccae KARI variant-2013_C1
MEECKMAKIYYQEDCNLSLLDGKTIAVIGYGSQGHAHALNAKESGCNVIIGLLEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEIKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 534 - protein, 343 aa, Artificial sequence
  Anaerostipes caccae KARI variant-2013_C6
MEECKMAKIYYQEDCNLSLLDGMTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETDTDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 535 - protein, 343 aa, Artificial sequence; identical to SEQ ID NO: 442
  Anaerostipes caccae KARI variant-2013_C8

SEQ ID NO: 536 - protein, 343 aa, Artificial sequence
  Anaerostipes caccae KARI variant-2013_C12
MEECKMAKIYYQEDCNLSLLDGKTIAVIGYGSQGHAHALNAKESGCNVIIGLFEGAEEWKRAEEQGFEVYTTAEAAKKADIIMILIPDEKQASMYKNDIEPNLEAGNMLMFAHGFNIHFGCIVPPKDVDVTMIAPKGPGHTVRSEYEEGKGVPCLVAVEQDATGKALDMALAYALVIGGARAGVLETTFRTETETDLFGEQAVLCGGVCALMQAGFETLVEAGYDPRNAYFECIYEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 537 - protein, 343 aa, Artificial sequence
  Anaerostipes caccae KARI variant-2013_D1
MEECKMAKIYYQEDCNLSLLDGKTIAVIGYGSQGHAHALNAKESGCNVIIGLFEGAEEWKRAEEQGFEVYTAAEAAKKADIIMILIPDEKQATRYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFMAMRKLASEHPAEVVGEEIRSLYSWSDEDKLINN

SEQ ID NO: 538 - DNA, 636 bp, Artificial sequence
  Promoter UAS(PGK1)-ENO2p
aattaccgtcgctcgtgatttgtttgcaaaaagaacaaaactgaaaaaacccagacacgctcgacttcctgtcttcctattgattgcagcttccaatttcgtcacacaacaaggtcctgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 539 - DNA, 979 bp, Artificial sequence
  UAS(FBA1)-PDC1p
tgacagcaggattatcgtaatacgtaatagttgaaaatctcaaaaatgtgtgggtcattacgtaaataatgataggaatgggattcttctatttttcctttttccattctcgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 540 - DNA, 994 bp, Artificial sequence
  Promoter UAS(PGK1)-PDC1p
aattaccgtcgctcgtgatttgtttgcaaaaagaacaaaactgaaaaaacccagacacgctcgacttcctgtcttcctattgattgcagcttccaatttcgtcacacaacaaggtcctgtcgacccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 541 - DNA, 731 bp, Artificial sequence
  Promoter UAS(PGK)-OLE1p
aattaccgtcgctcgtgatttgtttgcaaaaagaacaaaactgaaaaaacccagacacgctcgacttcctgtcttcctattgattgcagcttccaatttcgtcacacaacaaggtcctgtcgaccggggcgcccgtgcaaaaactaactccgagcccgggcatgtcccgggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaa

SEQ ID NO: 542 - protein, 546 aa, Macrococcus caseolyticus
MKQRIGQYLIDALHVNGVDKIFGVPGDFTLAFLDDIIRHDNVEWVGNTNELNAAYAADGYARVNGLAAVSTTFGVGELSAVNGIAGSYAERVPVIKISGGPSSVAQQEGRYVHHSLGEGIFDSYSKMYAHITATTTILSVDNAVDEIDRVIHCALKEKRPVHIHLPIDVALTEIEIPHAPKVYTHESQNVDAYIQAVEKKLMSAKQPVIIAGHEINSFKLHEQLEQFVNQTNIPVAQLSLGKSAFNEENEHYLGIYDGKIAKENVREYVDNADVILNIGAKLTDSATAGFSYKFDTNNIIYINHNDFKAEDVISDNVSLIDLVNGLNSIDYRNETHYPSYQRSDMKYELNDAPLTQSNYFKMMNAFLEKDDILLAEQGTSFFGAYDLSLYKGNQFIGQPLWGSIGYTFPSLLGSQLADMHRRNILLIGDGSLQLTVQALSTMIRKDIKPIIFVINNDGYTVERLIHGMEEPYNDIQMWNYKQLPEVFGGKDTVKVHDAKTSNELKTVMDSVKADKDHMHFIEVHMAVEDAPKKLIDIAKAFSDANK

SEQ ID NO: 543 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 544 - DNA, 24 bp, Artificial sequence
  Primer K9_53F_031411f
gttatcatcggattattcgaagga

SEQ ID NO: 545 - DNA, 24 bp, Artificial sequence
  Primer K9_53L_031411f
gttatcatcggattattggaagga

SEQ ID NO: 546 - DNA, 24 bp, Artificial sequence
  Primer K9_53Y_031411f
gttatcatcggattatatgaagga

SEQ ID NO: 547 - DNA, 24 bp, Artificial sequence
  Primer K9_53C_031411f
gttatcatcggattatgtgaagga

SEQ ID NO: 548 - DNA, 24 bp, Artificial sequence
  Primer K9_53W_031411f
gttatcatcggattatgggaagga

SEQ ID NO: 549 - DNA, 24 bp, Artificial sequence
  Primer K9_53P_031411f
gttatcatcggattaccagaagga

SEQ ID NO: 550 - DNA, 24 bp, Artificial sequence
  Primer K9_53H_031411f
gttatcatcggattacatgaagga

SEQ ID NO: 551 - DNA, 24 bp, Artificial sequence
  Primer K9_53Q_031411f
gttatcatcggattacaagaagga

SEQ ID NO: 552 - DNA, 24 bp, Artificial sequence
  Primer K9_53I_031411f
gttatcatcggattaattgaagga

SEQ ID NO: 553 - DNA, 24 bp, Artificial sequence
  Primer K9_53M_031411f
gttatcatcggattaatggaagga

SEQ ID NO: 554 - DNA, 24 bp, Artificial sequence
  Primer K9_53N_031411f
gttatcatcggattaaatgaagga

SEQ ID NO: 555 - DNA, 24 bp, Artificial sequence
  Primer K9_53V_031411f
gttatcatcggattagttgaagga

SEQ ID NO: 556 - DNA, 24 bp, Artificial sequence
  Primer K9_53A_031411f
gttatcatcggattagctgaagga

SEQ ID NO: 557 - DNA, 24 bp, Artificial sequence
  Primer K9_53D_031411f
gttatcatcggattagatgaagga

SEQ ID NO: 558 - DNA, 24 bp, Artificial sequence
  Primer K9_53E_031411f
gttatcatcggattagaagaagga

SEQ ID NO: 559 - DNA, 24 bp, Artificial sequence
  Primer  K9_53G_031411f
gttatcatcggattaggtgaagga

SEQ ID NO: 560 - DNA, 21 bp, Artificial sequence
  Primer K9_56F_031411f
ggattacctgaaggattcaaa

SEQ ID NO: 561 - DNA, 21 bp, Artificial sequence
  Primer K9_56L_031411f
ggattacctgaaggattgaaa

SEQ ID NO: 562 - DNA, 21 bp, Artificial sequence
  Primer K9_56Y_031411f
ggattacctgaaggatataaa

SEQ ID NO: 563 - DNA, 21 bp, Artificial sequence
  Primer K9_56C_031411f
ggattacctgaaggatgtaaa

SEQ ID NO: 564 - DNA, 21 bp, Artificial sequence
  Primer K9_56W_031411f
ggattacctgaaggatggaaa

SEQ ID NO: 565 - DNA, 21 bp, Artificial sequence
  Primer K9_56P_031411f
ggattacctgaaggaccaaaa

SEQ ID NO: 566 - DNA, 21 bp, Artificial sequence
  Primer K9_56H_031411f
ggattacctgaaggacataaa

SEQ ID NO: 567 - DNA, 21 bp, Artificial sequence
  Primer K9_56Q_031411f
ggattacctgaaggacaaaaa

SEQ ID NO: 568 - DNA, 21 bp, Artificial sequence
  Primer K9_56I_031411f
ggattacctgaaggaattaaa

SEQ ID NO: 569 - DNA, 21 bp, Artificial sequence
  Primer K9_56M_031411f
ggattacctgaaggaatgaaa

SEQ ID NO: 570 - DNA, 21 bp, Artificial sequence
  Primer K9_56N_031411f
ggattacctgaaggaaataaa

SEQ ID NO: 571 - DNA, 21 bp, Artificial sequence
  Primer K9_56V_031411f
ggattacctgaaggagttaaa

SEQ ID NO: 572 - DNA, 21 bp, Artificial sequence
  Primer K9_56A_031411f
ggattacctgaaggagctaaa

SEQ ID NO: 573 - DNA, 21 bp, Artificial sequence
  Primer K9_56D_031411f
ggattacctgaaggagataaa

SEQ ID NO: 574 - DNA, 21 bp, Artificial sequence
  Primer K9_56E_031411f
ggattacctgaaggagaaaaa

SEQ ID NO: 575 - DNA, 21 bp, Artificial sequence
  Primer       K9_56G_031411f
ggattacctgaaggaggtaaa

SEQ ID NO: 576 - DNA, 34 bp, Artificial sequence
  Primer K9_58F_051611f
gattacctgaaggatttaaattctggaagagagc

SEQ ID NO: 577 - DNA, 34 bp, Artificial sequence
  Primer K9_58L_051611f
gattacctgaaggatttaaattgtggaagagagc

SEQ ID NO: 578 - DNA, 34 bp, Artificial sequence
  Primer K9_58Y_051611f
gattacctgaaggatttaaatattggaagagagc

SEQ ID NO: 579 - DNA, 34 bp, Artificial sequence
  Primer K9_58C_051611f
gattacctgaaggatttaaatgttggaagagagc

SEQ ID NO: 580 - DNA, 34 bp, Artificial sequence
  Primer K9_58W_051611f
gattacctgaaggatttaaatggtggaagagagc

SEQ ID NO: 581 - DNA, 34 bp, Artificial sequence
  Primer K9_58P_051611f
gattacctgaaggatttaaaccatggaagagagc

SEQ ID NO: 582 - DNA, 34 bp, Artificial sequence
  Primer K9_58H_051611f
gattacctgaaggatttaaacattggaagagagc

SEQ ID NO: 583 - DNA, 34 bp, Artificial sequence
  Primer K9_58Q_051611f
gattacctgaaggatttaaacaatggaagagagc

SEQ ID NO: 584 - DNA, 34 bp, Artificial sequence
  Primer K9_58I_051611f
gattacctgaaggatttaaaatttggaagagagc

SEQ ID NO: 585 - DNA, 34 bp, Artificial sequence
  Primer K9_58M_051611f
gattacctgaaggatttaaaatgtggaagagagc

SEQ ID NO: 586 - DNA, 34 bp, Artificial sequence
  Primer K9_58N_051611f
gattacctgaaggatttaaaaattggaagagagc

SEQ ID NO: 587 - DNA, 34 bp, Artificial sequence
  Primer K9_58V_051611f
gattacctgaaggatttaaagtttggaagagagc

SEQ ID NO: 588 - DNA, 34 bp, Artificial sequence
  Primer K9_58A_051611f
gattacctgaaggatttaaagcttggaagagagc

SEQ ID NO: 589 - DNA, 34 bp, Artificial sequence
  Primer K9_58D_051611f
gattacctgaaggatttaaagattggaagagagc

SEQ ID NO: 590 - DNA, 34 bp, Artificial sequence
  Primer K9_58E_051611f
gattacctgaaggatttaaagaatggaagagagc

SEQ ID NO: 591 - DNA, 34 bp, Artificial sequence
  Primer K9_58G_051611f
gattacctgaaggatttaaaggttggaagagagc

SEQ ID NO: 592 - DNA, 26 bp, Artificial sequence
  Primer K9_56F_071211r
gctctcttccatggtttgaatccttc

SEQ ID NO: 593 - DNA, 26 bp, Artificial sequence
  Primer K9_56L_071211r
gctctcttccatggtttcaatccttc

SEQ ID NO: 594 - DNA, 26 bp, Artificial sequence
  Primer K9_56Y_071211r
gctctcttccatggtttatatccttc

SEQ ID NO: 595 - DNA, 26 bp, Artificial sequence
  Primer K9_56C_071211r
gctctcttccatggtttacatccttc

SEQ ID NO: 596 - DNA, 26 bp, Artificial sequence
  Primer K9_56W_071211r
gctctcttccatggtttccatccttc

SEQ ID NO: 597 - DNA, 26 bp, Artificial sequence
  Primer K9_56P_071211r
gctctcttccatggttttggtccttc

SEQ ID NO: 598 - DNA, 26 bp, Artificial sequence
  Primer K9_56H_071211r
gctctcttccatggtttatgtccttc

SEQ ID NO: 599 - DNA, 26 bp, Artificial sequence
  Primer K9_56Q_071211r
gctctcttccatggtttttgtccttc

SEQ ID NO: 600 - DNA, 26 bp, Artificial sequence
  Primer K9_56I_071211r
gctctcttccatggtttaattccttc

SEQ ID NO: 601 - DNA, 26 bp, Artificial sequence
  Primer K9_56M_071211r
gctctcttccatggtttcattccttc

SEQ ID NO: 602 - DNA, 26 bp, Artificial sequence
  Primer K9_56N_071211r
gctctcttccatggtttatttccttc

SEQ ID NO: 603 - DNA, 26 bp, Artificial sequence
  Primer K9_56V_071211r
gctctcttccatggtttaactccttc

SEQ ID NO: 604 - DNA, 26 bp, Artificial sequence
  Primer K9_56A_071211r
gctctcttccatggtttagctccttc

SEQ ID NO: 605 - DNA, 26 bp, Artificial sequence
  Primer K9_56D_071211r
gctctcttccatggtttatctccttc

SEQ ID NO: 606 - DNA, 26 bp, Artificial sequence
  Primer K9_56E_071211r
gctctcttccatggtttttctccttc

SEQ ID NO: 607 - DNA, 26 bp, Artificial sequence
  Primer K9_56G_071211r
gctctcttccatggtttacctccttc

SEQ ID NO: 608 - DNA, 25 bp, Artificial sequence
  Primer K9_58F_071211r
gttcttctgctctcttccagaattt

SEQ ID NO: 609 - DNA, 25 bp, Artificial sequence
  Primer K9_58L_071211r
gttcttctgctctcttccacaattt

SEQ ID NO: 610 - DNA, 25 bp, Artificial sequence
  Primer K9_58Y_071211r
gttcttctgctctcttccaatattt

SEQ ID NO: 611 - DNA, 25 bp, Artificial sequence
  Primer K9_58C_071211r
gttcttctgctctcttccaacattt

SEQ ID NO: 612 - DNA, 25 bp, Artificial sequence
  Primer K9_58W_071211r
gttcttctgctctcttccaccattt

SEQ ID NO: 613 - DNA, 25 bp, Artificial sequence
  Primer K9_58P_071211r
gttcttctgctctcttccatggttt

SEQ ID NO: 614 - DNA, 25 bp, Artificial sequence
  Primer K9_58H_071211r
gttcttctgctctcttccaatgttt

SEQ ID NO: 615 - DNA, 25 bp, Artificial sequence
  Primer K9_58Q_071211r
gttcttctgctctcttccattgttt

SEQ ID NO: 616 - DNA, 25 bp, Artificial sequence
  Primer K9_58I_071211r
gttcttctgctctcttccaaatttt

SEQ ID NO: 617 - DNA, 25 bp, Artificial sequence
  Primer K9_58M_071211r
gttcttctgctctcttccacatttt

SEQ ID NO: 618 - DNA, 25 bp, Artificial sequence
  Primer K9_58N_071211r
gttcttctgctctcttccaattttt

SEQ ID NO: 619 - DNA, 25 bp, Artificial sequence
  Primer K9_58V_071211r
gttcttctgctctcttccaaacttt

SEQ ID NO: 620 - DNA, 25 bp, Artificial sequence
  Primer K9_58A_071211r
gttcttctgctctcttccaagcttt

SEQ ID NO: 621 - DNA, 25 bp, Artificial sequence
  Primer K9_58D_071211r
gttcttctgctctcttccaatcttt

SEQ ID NO: 622 - DNA, 25 bp, Artificial sequence
  Primer K9_58E_071211r
gttcttctgctctcttccattcttt

SEQ ID NO: 623 - DNA, 25 bp, Artificial sequence
  Primer K9_58G_071211r
gttcttctgctctcttccaaccttt

SEQ ID NO: 624 - protein, 343 aa, Artificial sequence
  Anaerostipes caccae KARI variant-BI7D12
MEECKMAKIYYQEDCNLSLLDGKTIAVIGYGSQGHAHALNAKESGCNVIIGLQEGVKDWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 625 - DNA, 1029 bp, Artificial sequence
  coding sequence for Anaerostipes caccae KARI variant- BI7D12
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttacaagaaggtgttaaggactggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 626 - protein, 343 aa, Artificial sequence
  Anaerostipes caccae KARI variant-BI10F1
MEECKMAKIYYQEDCNLSLLDGKTIAVIGYGSQGHAHALNAKESGCNVIIGLEEGVKDWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 627 - DNA, 1029 bp, Artificial sequence
  coding sequence for Anaerostipes caccae KARI variant-BI10F1
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttagaagaaggtgttaaggactggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 628 - protein, 343 aa, Artificial sequence
  Anaerostipes caccae KARI variant-BJ6G6
MEECKMAKIYYQEDCNLSLLDGKTIAVIGYGSQGHAHALNAKESGCNVIIGLPEGDKQWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 629 - DNA, 1029 bp, Artificial sequence
  Anaerostipes caccae KARI variant-BJ6G6
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttacctgaaggtgataagcactggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 630 - protein, 343 aa, Artificial sequence
  Anaerostipes caccae KARI variant-BJ7D6
MEECKMAKIYYQEDCNLSLLDGKTIAVIGYGSQGHAHALNAKESGCNVIIGLPEGVKEWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 631 - DNA, 1029 bp, Artificial sequence
  coding sequence for Anaerostipes caccae KARI variant-BJ7D6
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttacctgaaggtgttaaggactggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 632 - protein, 343 aa, Artificial sequence
  Anaerostipes caccae KARI variant-BJ7F7
MEECKMAKIYYQEDCNLSLLDGKTIAVIGYGSQGHAHALNAKESGCNVIIGLAEGDKQWKRAEEQGFEVYTAAEAAKKADIIMILVPDEKQATMYKNDIEPNLEAGNMLMFAHGFNIHFGCIVPPKDVDVMMIAPKGPGHTVRSEYEEGKGVPCLVAVEQDATGKALDMALAYALAIGGARAGVLETTFRGETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 633 - DNA, 1029 bp, Artificial sequence
  coding sequence for Anaerostipes caccae KARI variant-BJ7F7
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttagctgaaggtgataagcactggaaaagagctgaagaacaaggtttcgaagtctacaccgctgctgaagctgctaagaaggctgacatcattatgatcttggtgccggatgaaaagcaggctaccatgtacaaaaacgacatcgaaccaaacttggaagccggtaacatgttgatgttcgctcacggtttcaacatccatttcggttgtattgttccaccaaaggacgttgatgtcatgatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaggggaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaac

SEQ ID NO: 634 - DNA, 24 bp, Artificial sequence
  Primer pBAD_266f
ctctctactgtttctccatacccg

SEQ ID NO: 635 - protein, 338 aa, Artificial sequence
  N-terminal truncated Anaerostipes caccae KARI variant
MAKIYYQEDCNLSLLDGKTIAVIGYGSQGHAHALNAKESGCNVIIGLYEGSKSWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 636 - DNA, 1017 bp, Artificial sequence
  coding sequence for N-terminal truncated Anaerostipes caccae KARI variant
atggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggttctaagtcctggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 637 - protein, 338 aa, Artificial sequence
  N-terminal truncated Anaerostipes caccae KARI K9SB2 variant
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 638 - DNA, 1017 bp, Artificial sequence
  coding sequence for N-terminal truncated Anaerostipes caccae K9SB2 KARI variant
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 639 - protein, 343 aa, Artificial sequence
  Anaerostipes caccae KARI variant-K9SB2-T93I
MEECKMAKIYYQEDCNLSLLDGKTIAVIGYGSQGHAHALNAKESGCNVIIGLFEGAEEWKRAEEQGFEVYTAAEAAKKADIIMILIPDEKQAIMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 640 - DNA, 1032 bp, Artificial sequence
  coding sequence for Anaerostipes caccae KARI variant-K9SB2-T93I
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctatcatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgaggaagttggcctccgaacacccagctgaagttgtcggtgaagaaattagatccttgtactcctggtccgacgaagacaagttgattaacaactga

SEQ ID NO: 641 - protein, 343 aa, Artificial sequence
  Anaerostipes caccae KARI variant-K9SB2-T93A
MEECKMAKIYYQEDCNLSLLDGKTIAVIGYGSQGHAHALNAKESGCNVIIGLFEGAEEWKRAEEQGFEVYTAAEAAKKADIIMILIPDEKQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 642 - DNA, 1032 bp, Artificial sequence
  coding sequence for Anaerostipes caccae KARI variant K9SB2-T93A
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctgccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccgggtacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 643 - protein, 343 aa, Artificial Sequence; identical to SEQ ID NO: 27
  Anaerostipes caccae DSM 14662

SEQ ID NO: 644 - protein, 343 aa, Artificial Sequence; identical to SEQ ID NO: 35
  Anaerostipes caccae KARI AB1G9 variant

SEQ ID NO: 645 - protein, 343 aa, Artificial Sequence; identical to SEQ ID NO: 33
  Anaerostipes caccae KARI-AB1D3 variant

SEQ ID NO: 646 - protein, 343 aa, Artificial Sequence; identical to SEQ ID NO: 33
  Anaerostipes caccae KARI- K9D3 variant

SEQ ID NO: 647 - protein, 343 aa, Artificial Sequence; identical to SEQ ID NO: 35
  Anaerostipes caccae KARI-K9G9 variant

SEQ ID NO: 648 - DNA, 1689 bp, Artificial Sequence
  PDC1 pyruvate decarboxylase from Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaa

SEQ ID NO: 649 - protein, 563 aa, Artificial Sequence
  PDC1 pyruvate decarboxylase from Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 650 - DNA, 1689 bp, Artificial Sequence
  PDC5 pyruvate decarboxylase from Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaa

SEQ ID NO: 651 - protein, 563 aa, Artificial Sequence
  PDC5 pyruvate decarboxylase from Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 652 - DNA, 1599 bp, Artificial Sequence
  PDC6 pyruvate decarboxylase from Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 653 - protein, 533 aa, Artificial Sequence
  PDC6 pyruvate decarboxylase from Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 654 - DNA, 1692 bp, Artificial Sequence
  pyruvate decarboxylase from Candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 655 - protein, 564 aa, Artificial Sequence
  pyruvate decarboxylase from Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 656 - DNA, 1788 bp, Artificial Sequence
  PDC1 pyruvate decarboxylase from Pichia stipitis
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 657 - protein, 596 aa, Artificial Sequence
  PDC1 pyruvate decarboxylase from Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 658 - DNA, 1707 bp, Artificial Sequence
  PDC2 pyruvate decarboxylase from Pichia stipitis
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 659 - protein, 569 aa, Artificial Sequence
  PDC2 pyruvate decarboxylase from Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 660 - DNA, 1692 bp, Artificial Sequence
  pyruvate decarboxylase from Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtgctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctcacttggttctatcggtcggtgctctattgtccgatttcaacactggttctttctcttactcttacaagaccaagaacattgtcgaattccactctgactacaccaagatcagaaggcctaccttcccaggtgtccaaatgaagttcgctttacaaaaattgttgactaaggttgccgatgctgctaagggttacaagccagttccagttccatctgaaccagaacacaacgaagatgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgcatccaacgctaagaactaa

SEQ ID NO: 661 - protein, 563 aa, Artificial Sequence
  pyruvate decarboxylase from Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 662 - DNA, 1716 bp, Artificial Sequence
  pyruvate decarboxylase from Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtttag

SEQ ID NO: 663 - protein, 571 aa, Artificial Sequence
  pyruvate decarboxylase from Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 664 - DNA, 1716 bp, Artificial Sequence
  pyruvate decarboxylase from Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaatga

SEQ ID NO: 665 - protein, 571 aa, Artificial Sequence
  pyruvate decarboxylase from Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 666 - DNA, 1689 bp, Artificial Sequence
  pyruvate decarboxylase from Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 667 - protein, 563 aa, Artificial Sequence
  pyruvate decarboxylase from Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 668 - DNA, 1461 bp, Artificial Sequence
  HXK2 from S. cerevisiae
atggttcatttaggtccaaaaaaaccacaagccagaaagggttccatggccgatgtgccaaaggaattgatgcaacaaattgagaattttgaaaaaattttcactgttccaactgaaactttacaagccgttaccaagcacttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcactaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgcttaa

SEQ ID NO: 669 - protein, 486 aa, Artificial Sequence
  HXK2 from S. cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 670 - DNA, 1458 bp, Artificial Sequence
  RAG5 from K. lactis
atggttcgtttaggtccaaagaagcctccagccagaaaggggtccatggcagatgtgccagctaatttgatggaacaaatccacggtttggaaactttgttcaccgtctcttcagaaaaaatgagaagcattgtcaagcatttcatcagtgaattggacaaaggtttgtccaaaaagggtggtaacattcctatgattccaggttgggttgttgagtatccaactggtaaggaaactggtgatttcttagctcttgatttgggtggtaccaacttgagagttgtgttggttaaattgggtggtaatcatgatttcgacaccactcaaaacaagtacagattaccagaccatttgagaactggtacttctgaacaattgtggtcatttattgcaaagtgtttgaaggaattcgtcgatgaatggtacccagatggtgtttctgaaccattgccattgggtttcactttctcataccctgcatctcaaaagaagatcaattccggtgtgttgcaacgttggaccaagggtttcgatattgaaggtgttgaaggtcacgatgttgttccaatgctacaagaacagattgaaaagctgaatatcccaatcaatgtcgttcgattgatcaacgataccactggtaccttggttgcctctttgtacactgatcctcaaactaagatgggtatcattatcggtactggtgtcaacggtgcttactacgatgttgtttctggtattgagaaattggaaggtttgttgccagaagatatcggtccagattctccaatggcaatcaactgtgaatatggttccttcgataacgaacatttggtgttgccaagaaccaaatacgatgttataatcgatgaagaatctccaagaccaggtcaacaagctttcgaaaagatgacttctggttactatctaggtgaaatcatgcgtctagtactattggacttgtacgacagtggtttcatctttaaggaccaagatatctccaagttgaaagaggcttacgtcatggacaccagttatccatctaagatcgaagatgatccattcgaaaacttggaagacactgacgatctgttcaagactaacttgaacatcgaaactaccgttgttgagagaaagttgattagaaaattagccgaattggtcggaacaagagctgcaagattgactgtttgtggtgtttctgctatctgtgacaagagaggctacaagactgctcacattgcagctgatggttctgtcttcaacagatacccaggttacaaggaaaaggccgctcaagccttgaaggatatctacaactgggatgtcgaaaagatggaagaccacccaatccaattggtggctgctgaagatggttccggtgttggtgctgctatcattgcttgtttgactcaaaagagattggctgccggtaagtctgttggtattaaaggcgaatag

SEQ ID NO: 671 - protein, 485 aa, Artificial Sequence
  RAG5 from K. lactis
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVRLINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 672 - DNA, 1416 bp, Artificial Sequence
  HPGLK1 from H. polymorpha
atgagtttggatactgaagtcgataagattgtgtcggagtttgccgtcacccaggagacactccaaaagggtgtggagcgtttcattgagcttgcaactgccggactgaatagtgatgaggacaagtatggtctgccaatgatcccaacttttgttacctccatcccaaccggtaaagagaagggcattctttttgccgcagacttgggaggaaccaatttcagagtttgctctgttgccttgaacggagatcacactttcaaactgatccagcagaagtcacatattcctgccgaactgatgacctccacctcggacgaattgttttcgtatcttgcaagcaaggtcaagaatttcttagagactcatcatgaaggggctgttacttctacaggaagccagaaattcaagatgggtttcactttcagtttccctgtctcgcagaccgccttaaacgccggtactttgctaagatggaccaagggattcaatattccggatactgttggtcaagaggttgtttctctattccaaatgcatttagacgcccaggaaattcctgttactgtgtctgccctgtccaacgatactgtgggaacccttcttgcaagatcctacacgggttccaataaggagggcactactgttctaggatgcatcttcggaacgggaacaaacggtgcttacaacgagaagctcgagaatatcaagaagcttccggccgaggtgagagagaagctgaaggctcaaggtgtcacccacatggtcattaatactgaatggggttccttcgataaccagctcaaggttttgccaaatacgaagtatgacgctcaagttgacgaacttaccggcaataagggcttccacatgtttgaaaagcgtgtttccggaatgttcttgggtgagattctgagacatattttggtcgaccttcactctaagggagtgctatttactcagtacgccagctacgaatccctgccccacagattgaggacgccgtgggatctggactctgaggttctctcactgattgagatcgacgaatccaccaatttgcaggccactgagctgtctttgaaacaggcattgagactgccaactactactgaggagagacttgctattcaaaaacttactcgtgctgtggccaagagatctgcctatcttgctgctattcctattgctgctattctacacatgaccgagtcttttaagggccacaacgttgaggtggacgttggagcagacgggtctgtggttgagttctaccctggattcagaactatgatgagagacgccattgcgcagacgcagataggtgccaaaggagagagaagactgcacattaacattgccaaagacggctcatctgtgggcgctgcattgtgcgcattaagcgagaaagactaa

SEQ ID NO: 673 - protein, 471 aa, Artificial Sequence
  HPGLK1 from H. polymorpha
MSLDTEVDKIVSEFAVTQETLQKGVERFIELATAGLNSDEDKYGLPMIPTFVTSIPTGKEKGILFAADLGGTNFRVCSVALNGDHTFKLIQQKSHIPAELMTSTSDELFSYLASKVKNFLETHHEGAVTSTGSQKFKMGFTFSFPVSQTALNAGTLLRWTKGFNIPDTVGQEVVSLFQMHLDAQEIPVTVSALSNDTVGTLLARSYTGSNKEGTTVLGCIFGTGTNGAYNEKLENIKKLPAEVREKLKAQGVTHMVINTEWGSFDNQLKVLPNTKYDAQVDELTGNKGFHMFEKRVSGMFLGEILRHILVDLHSKGVLFTQYASYESLPHRLRTPWDLDSEVLSLIEIDESTNLQATELSLKQALRLPTTTEERLAIQKLTRAVAKRSAYLAAIPIAAILHMTESFKGHNVEVDVGADGSVVEFYPGFRTMMRDAIAQTQIGAKGERRLHINIAKDGSSVGAALCALSEKD

SEQ ID NO: 674 - DNA, 1634 bp, Artificial Sequence
  HXK2 from S. pombe
aacacttttcgcctcacttgcgaatctacgaaaggaatatataggtggttcaccccttttcttttcatttcgtgtttttaatagttatttacatcaacagagataactatttctgttaacgattttttttcccacttgttttcttccttttttggtgaattttaattaatttataataagcaatggaggctaattttcaacaagctgttaaaaagttagtcaatgactttgaataccctaccgagtccttgagagaggccgttaaggagtttgacgaattacgtcaaaagggtttacaaaagaatggtgaggtgcttgctatggctcctgcctttatctctacccttcccaccggcgctgaaactggtgacttcttggcccttgactttggtggtaccaacttgcgtgtttgttggatccaacttctcggtgacggcaagtatgagatgaagcacagcaagtccgtcttgccccgtgaatgcgttcgtaacgagtctgttaagcccatcattgactttatgagtgaccatgttgagcttttcatcaaggagcacttcccttccaagtttggctgccctgaggaggaataccttcctatgggtttcaccttttcttatcccgccaaccaagtttccatcaccgagagctacttgcttcgttggaccaagggtcttaacattcctgaggccatcaacaaggactttgcccaatttttgactgaaggtttcaaggctcgtaaccttcctattagaatcgaggctgtcatcaacgataccgtcggtactctcgttacccgtgcttatacttcaaaggagagcgacacctttatgggtatcattttcggaaccggtaccaacggtgcttacgtcgagcaaatgaaccaaattcccaagcttgctggcaagtgtactggtgatcatatgcttatcaacatggaatggggagcaactgatttctcttgccttcactccactcgttatgatttacttcttgatcatgatactcccaatgctggtcgtcaaatctttgagaagcgcgttggtggtatgtatctcggtgagcttttccgccgtgccttattccacttgatcaaggtttacaacttcaacgaaggtattttccctccttccattactgatgcttggtctttggaaacttctgttctttccagaatgatggttgaacgttctgctgagaatgttcgtaacgttcttagtacattcaagttccgtttccgcagcgacgaagaggctttgtacctttgggatgctgctcatgcaattggccgtcgtgctgctcgtatgtctgccgttcccattgcttctttgtatctttctaccggccgcgctggtaagaagagtgatgttggtgttgatggttctttagtcgaacactatcctcactttgttgacatgctccgtgaagccttgcgtgagcttatcggtgataacgaaaaattgatttccattggtattgccaaggatggcagtggtattggtgccgctctttgcgccctccaagctgttaaggaaaagaaaggcttggcctaaatcatgttagatgtctgttagctttttttgaattgtacgtagaaatgagcatgtaaatatgaaattgctttttaacagctttta

SEQ ID NO: 675 - protein, 455 aa, Artificial Sequence
  HXK2 from S. pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 676 - DNA, 804 bp, Artificial Sequence; identical to SEQ ID NO: 280
  YMR226C

SEQ ID NO: 677 - protein, 267 aa, Artificial Sequence; identical to SEQ ID NO: 278
  YMR226C

SEQ ID NO: 678 - DNA, 1410 bp, Artificial Sequence
  YIL074C (Chr 9)
atgtcttattcagctgccgataatttacaagattcattccaacgtgccatgaacttttctggctctcctggtgcagtctcaacctcaccaactcagtcatttatgaacacactacctcgtcgtgtaagcattacaaagcaaccaaaggctttaaaacctttttctactggtgacatgaatattctactgttggaaaatgtcaatgcaactgcaatcaaaatcttcaaggatcagggttaccaagtagagttccacaagtcttctctacctgaggatgaattgattgaaaaaatcaaagacgtacacgctatcggtataagatccaaaactagattgactgaaaaaatactacagcatgccaggaatctagtttgtattggttgtttttgcataggtaccaatcaagtagacctaaaatatgccgctagtaaaggtattgctgttttcaattcgccattctccaattcaagatccgtagcagaattggtaattggtgagatcattagtttagcaagacaattaggtgatagatccattgaactgcatacaggtacatggaataaagtcgctgctaggtgttgggaagtaagaggaaaaactctcggtattattgggtatggtcacattggttcgcaattatcagttcttgcagaagctatgggcctgcatgtgctatactatgatatcgtgacaattatggccttaggtactgccagacaagtttctacattagatgaattgttgaataaatctgattttgtaacactacatgtaccagctactccagaaactgaaaaaatgttatctgctccacaattcgctgctatgaaggacggggcttatgttattaatgcctcaagaggtactgtcgtggacattccatctctgatccaagccgtcaaggccaacaaaattgcaggtgctgctttagatgtttatccacatgaaccagctaagaacggtgaaggttcatttaacgatgaacttaacagctggacttctgagttggtttcattaccaaatataatcctgacaccacatattggtggctctacagaagaagctcaaagttcaatcggtattgaggtggctactgcattgtccaaatacatcaatgaaggtaactctgtcggttctgtgaacttcccagaagtcagtttgaagtctttggactacgatcaagagaacacagtacgtgtcttgtatattcatcgtaacgttcctggtgttttgaagaccgttaatgatatcttatccgatcataatatcgagaaacagttttctgattctcacggcgagatcgcttatctaatggcagacatctcttctgttaatcaaagtgaaatcaaggatatatatgaaaagttgaaccaaacttctgccaaagtttccatcaggttattatactaa

SEQ ID NO: 679 - protein, 469 aa, Artificial Sequence
  YIL074C (Chr 9)
MSYSAADNLQDSFQRAMNFSGSPGAVSTSPTQSFMNTLPRRVSITKQPKALKPFSTGDMNILLLENVNATAIKIFKDQGYQVEFHKSSLPEDELIEKIKDVHAIGIRSKTRLTEKILQHARNLVCIGCFCIGTNQVDLKYAASKGIAVFNSPFSNSRSVAELVIGEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVSLKSLDYDQENTVRVLYIHRNVPGVLKTVNDILSDHNIEKQFSDSHGEIAYLMADISSVNQSEIKDIYEKLNQTSAKVSIRLLY

SEQ ID NO: 680 - DNA, 792 bp, Artificial Sequence
  YIR036C (Chr 9)
atgggcaaggttattttgattacaggtgcctcccgtgggattggcctgcaattggtgaaaactgttatcgaagaggacgatgaatgcatcgtctacggcgtagcaagaacggaagctggtctgcagtctttgcaaagagaatacggtgcagacaaatttgtctatcgtgtcctcgacatcacggacaggtctcgaatggaagcgttggtggaggaaatccggcaaaagcatggaaaactggacggtattgtcgcaaatgcggggatgctagaaccggtgaagtccatctcccagtccaactccgaacacgacatcaagcagtgggaacggctgttcgatgtgaactttttcagcattgtctctttggtggcactgtgtttacccctcttgaagagctcgccatttgtaggcaacattgtcttcgtcagctctggagccagtgtgaaaccatataacggatggtcggcgtacggctgctcgaaagccgcattaaaccactttgccatggacattgccagtgaagagcccagtgataaagtgcgtgccgtgtgtattgcaccgggcgtcgttgacacgcagatgcagaaagatattagggaaacattgggtcctcagggcatgacacccaaggctctcgagaggtttactcaattgtacaagacttcgtcactgctggacccaaaggtgcctgcggcggtactagcgcaactcgtcctgaaaggtattcccgactctttgaacggtcaatatctccgctacaacgatgagcgactggggccggtgcagggctag

SEQ ID NO: 681 - protein, 263 aa, Artificial Sequence
  YIR036C (Chr 9)
MGKVILITGASRGIGLQLVKTVIEEDDECIVYGVARTEAGLQSLQREYGADKFVYRVLDITDRSRMEALVEEIRQKHGKLDGIVANAGMLEPVKSISQSNSEHDIKQWERLFDVNFFSIVSLVALCLPLLKSSPFVGNIVFVSSGASVKPYNGWSAYGCSKAALNHFAMDIASEEPSDKVRAVCIAPGVVDTQMQKDIRETLGPQGMTPKALERFTQLYKTSSLLDPKVPAAVLAQLVLKGIPDSLNGQYLRYNDERLGPVQG

SEQ ID NO: 682 - DNA, 1503 bp, Artificial Sequence
  YPL061W (ALD6)(Chr 16)
atgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaa

SEQ ID NO: 683 - protein, 500 aa, Artificial Sequence; identical to SEQ ID NO: 279
  YPL061W (ALD6)(Chr 16)

SEQ ID NO: 684 - DNA, 1029 bp, Artificial Sequence
  YPL088W (Chr 16)
atggttttagttaagcaggtaagactcggtaactcaggtcttaagatatcaccgatagtgataggatgtatgtcatacgggtccaagaaatgggcggactgggtcatagaggacaagacccaaattttcaagattatgaagcattgttacgataaaggtcttcgtacttttgacacagcagatttttattctaatggtttgagtgaaagaataattaaggagtttctggagtactacagtataaagagagaaacggtggtgattatgaccaaaatttacttcccagttgatgaaacgcttgatttgcatcataacttcactttaaatgaatttgaagaattggacttgtccaaccagcggggtttatccagaaagcatataattgctggtgtcgagaactctgtgaaaagactgggcacatatatagaccttttacaaattcacagattagatcatgaaacgccaatgaaagagatcatgaaggcattgaatgatgttgttgaagcgggccacgttagatacattggggcttcgagtatgttggcaactgaatttgcagaactgcagttcacagccgataaatatggctggtttcagttcatttcttcgcagtcttactacaatttgctctatcgtgaagatgaacgcgaattgattccttttgccaaaagacacaatattggtttacttccatggtctcctaacgcacgaggcatgttgactcgtcctctgaaccaaagcacggacaggattaagagtgatccaactttcaagtcgttacatttggataatctcgaagaagaacaaaaggaaattataaatcgtgtggaaaaggtgtcgaaggacaaaaaagtctcgatggctatgctctccattgcatgggttttgcataaaggatgtcaccctattgtgggattgaacactacagcaagagtagacgaagcgattgccgcactacaagtaactctaacagaagaagagataaagtacctcgaggagccctacaaaccccagaggcaaagatgttaa

SEQ ID NO: 685 - protein, 342 aa, Artificial Sequence
  YPL088W(Chr 16)
MVLVKQVRLGNSGLKISPIVIGCMSYGSKKWADWVIEDKTQIFKIMKHCYDKGLRTFDTADFYSNGLSERIIKEFLEYYSIKRETVVIMTKIYFPVDETLDLHHNFTLNEFEELDLSNQRGLSRKHIIAGVENSVKRLGTYIDLLQIHRLDHETPMKEIMKALNDVVEAGHVRYIGASSMLATEFAELQFTADKYGWFQFISSQSYYNLLYREDERELIPFAKRHNIGLLPWSPNARGMLTRPLNQSTDRIKSDPTFKSLHLDNLEEEQKEIINRVEKVSKDKKVSMAMLSIAWVLHKGCHPIVGLNTTARVDEAIAALQVTLTEEEIKYLEEPYKPQRQRC

SEQ ID NO: 686 - DNA, 1086 bp, Artificial Sequence
  YCR105W  (ADH7)(Chr 3)
atgctttacccagaaaaatttcagggcatcggtatttccaacgcaaaggattggaagcatcctaaattagtgagttttgacccaaaaccctttggcgatcatgacgttgatgttgaaattgaagcctgtggtatctgcggatctgattttcatatagccgttggtaattggggtccagtcccagaaaatcaaatccttggacatgaaataattggccgcgtggtgaaggttggatccaagtgccacactggggtaaaaatcggtgaccgtgttggtgttggtgcccaagccttggcgtgttttgagtgtgaacgttgcaaaagtgacaacgagcaatactgtaccaatgaccacgttttgactatgtggactccttacaaggacggctacatttcacaaggaggctttgcctcccacgtgaggcttcatgaacactttgctattcaaataccagaaaatattccaagtccgctagccgctccattattgtgtggtggtattacagttttctctccactactaagaaatggctgtggtccaggtaagagggtaggtattgttggcatcggtggtattgggcatatggggattctgttggctaaagctatgggagccgaggtttatgcgttttcgcgaggccactccaagcgggaggattctatgaaactcggtgctgatcactatattgctatgttggaggataaaggctggacagaacaatactctaacgctttggaccttcttgtcgtttgctcatcatctttgtcgaaagttaattttgacagtatcgttaagattatgaagattggaggctccatcgtttcaattgctgctcctgaagttaatgaaaagcttgttttaaaaccgttgggcctaatgggagtatcaatctcaagcagtgctatcggatctaggaaggaaatcgaacaactattgaaattagtttccgaaaagaatgtcaaaatatgggtggaaaaacttccgatcagcgaagaaggcgtcagccatgcctttacaaggatggaaagcggagacgtcaaatacagatttactttggtcgattatgataagaaattccataaatag

SEQ ID NO: 687 - protein, 361 aa, Artificial Sequence
  YCR105W  (ADH7)(Chr 3)
MLYPEKFQGIGISNAKDWKHPKLVSFDPKPFGDHDVDVEIEACGICGSDFHIAVGNWGPVPENQILGHEIIGRVVKVGSKCHTGVKIGDRVGVGAQALACFECERCKSDNEQYCTNDHVLTMWTPYKDGYISQGGFASHVRLHEHFAIQIPENIPSPLAAPLLCGGITVFSPLLRNGCGPGKRVGIVGIGGIGHMGILLAKAMGAEVYAFSRGHSKREDSMKLGADHYIAMLEDKGWTEQYSNALDLLVVCSSSLSKVNFDSIVKIMKIGGSIVSIAAPEVNEKLVLKPLGLMGVSISSSAIGSRKEIEQLLKLVSEKNVKIWVEKLPISEEGVSHAFTRMESGDVKYRFTLVDYDKKFHK

SEQ ID NO: 688 - DNA, 1035 bp, Artificial Sequence
  YDR541C (Chr 4)
atgtctaatacagttctagtttctggcgcttcaggttttattgccttgcatatcctgtcacaattgttaaaacaagattataaggttattggaactgtgagatcccatgaaaaagaagcaaaattgctaagacaatttcaacataaccctaatttaactttagaaattgttccggacatttctcatccaaatgctttcgataaggttctgcagaaacgtggacgtgagattaggtatgttctacacacggcctctccttttcattatgatactaccgaatatgaaaaagacttattgattcccgcgttagaaggtacaaaaaacatcctaaattctatcaagaaatatgcagcagacactgtagagcgtgttgttgtgacttcttcttgtactgctattataacccttgcaaagatggacgatcccagtgtggtttttacagaagagagttggaacgaagcaacctgggaaagctgtcaaattgatgggataaatgcttactttgcatccaagaagtttgctgaaaaggctgcctgggagttcacaaaagagaatgaagatcacatcaaattcaaactaacaacagtcaacccttctcttctttttggtcctcaacttttcgatgaagatgtgcatggccatttgaatacttcttgcgaaatgatcaatggcctaattcataccccagtaaatgccagtgttcctgattttcattccatttttattgatgtaagggatgtggccctagctcatctgtatgctttccagaaggaaaataccgcgggtaaaagattagtggtaactaacggtaaatttggaaaccaagatatcctggatattttgaacgaagattttccacaattaagaggtctcattcctttgggtaagcctggcacaggtgatcaagtcattgaccgcggttcaactacagataatagtgcaacgaggaaaatacttggctttgagttcagaagtttacacgaaagtgtccatgatactgctgcccaaattttgaagaagcagaacagattatga

SEQ ID NO: 689 - protein, 344 aa, Artificial Sequence
  YDR541C (Chr 4)
MSNTVLVSGASGFIALHILSQLLKQDYKVIGTVRSHEKEAKLLRQFQHNPNLTLEIVPDISHPNAFDKVLQKRGREIRYVLHTASPFHYDTTEYEKDLLIPALEGTKNILNSIKKYAADTVERVVVTSSCTAIITLAKMDDPSVVFTEESWNEATWESCQIDGINAYFASKKFAEKAAWEFTKENEDHIKFKLTTVNPSLLFGPQLFDEDVHGHLNTSCEMINGLIHTPVNASVPDFHSIFIDVRDVALAHLYAFQKENTAGKRLVVTNGKFGNQDILDILNEDFPQLRGLIPLGKPGTGDQVIDRGSTTDNSATRKILGFEFRSLHESVHDTAAQILKKQNRL

SEQ ID NO: 690 - DNA, 1410 bp, Artificial Sequence
  YER081 (SER3)(Chr 5)
atgacaagcattgacattaacaacttacaaaatacctttcaacaagctatgaatatgagcggctccccaggcgctgtttgtacttcacctacgcaatctttcatgaataccgttccacagcgcttgaatgctgtaaagcacccaaaaattttgaagcctttctcaacgggtgatatgaagattttactattagaaaacgttaatcaaactgctattacaatcttcgaagagcaaggttaccaagtcgaattctataaatcttcattgcccgaggaagagttgatcgaaaagatcaaggacgttcatgctattggtatcagatcaaagactagattaacttcaaatgtcttacaacatgcgaagaatctggtttgtattggttgtttctgtatcggtaccaaccaagttgacttagactacgctaccagcagaggtattgctgttttcaactcgcctttctccaactcaagatcagtagcagaattggtcatcgctgaaatcattagtttagcaagacaactaggtgatagatctatcgaattacataccggtacatggaataaggttgctgctagatgttgggaggtaagaggaaaaactcttggtattattgggtacggtcacattggttcccaattatcagttcttgcagaagctatgggtttgcatgtgttgtactacgatattgtaactatcatggccttgggtactgccagacaagtttctacattagatgaattgttgaataaatctgattttgtgacactacatgtaccagctactcctgaaactgaaaaaatgttatctgccccacaatttgctgctatgaaggatggcgcttatgttattaatgcttcaagaggtactgtcgtggacattccatctttgatccaagccgtgaaagccaacaaaattgcaggtgctgctttggatgtttatccacatgaaccagctaagaacggtgaaggttcatttaacgatgagctaaatagctggacttctgaattagtttcattaccaaatatcatcttgacaccacacattggtggctctaccgaagaagcccaaagctcaatcggtattgaagtggctaccgcattgtccaaatacatcaatgaaggtaactctgtcggttcagtcaacttcccagaagtggcattgaaatcattgtcttacgaccaagagaacactgtgcgtgtgttatacattcaccaaaatgtaccaggtgttttgaagaccgtcaatgatattttatcgaaccataacatcgaaaagcaattttccgattcaaatggtgaaattgcttatttaatggctgatatctcttctgttgaccaaagcgatattaaagatatttatgaacaactaaatcaaacctctgctaagatctcaattagattgctatattaa

SEQ ID NO: 691 - protein, 469 aa, Artificial Sequence
  YER081 (SER3)(Chr 5)
MTSIDINNLQNTFQQAMNMSGSPGAVCTSPTQSFMNTVPQRLNAVKHPKILKPFSTGDMKILLLENVNQTAITIFEEQGYQVEFYKSSLPEEELIEKIKDVHAIGIRSKTRLTSNVLQHAKNLVCIGCFCIGTNQVDLDYATSRGIAVFNSPFSNSRSVAELVIAEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVALKSLSYDQENTVRVLYIHQNVPGVLKTVNDILSNHNIEKQFSDSNGEIAYLMADISSVDQSDIKDIYEQLNQTSAKISIRLLY

SEQ ID NO: 692 - DNA, 711 bp, Artificial Sequence
  YPL275W  (FDH2)(Chr 16)
atggtggtcatcaataagcaattaatggtgagtgggatattgccggcgtggctaaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctgcatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 693 - protein, 236 aa, Artificial Sequence
  YPL275W  (FDH2)(Chr 16)
MVVINKQLMVSGILPAWLKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLHAQKRYAQGVKNILNSYFSKKFDYRPQDIIVQNGSYATRAYGQKK

SEQ ID NO: 694 - DNA, 1494 bp, Artificial Sequence
  YBR006W (UGA5)(Chr2)
atgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctggcaaccatcattactttagaaaatggtaaagctctaggggaagctaaaggagaaatcaaatacgcggcttcgtattttgagtggtacgccgaggaagcaccccgtttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacactttatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaa

SEQ ID NO: 695 - protein, 497 aa, Artificial Sequence
  YBR006W (UGA5)(Chr2)
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 696 - DNA, 1323 bp, Artificial Sequence
  YOL059W (Chr 15)
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 697 - protein, 440 aa, Artificial Sequence
  YOL059W (Chr 15)
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 698 - DNA, 804 bp, Artificial Sequence
  Saccharomyces paradoxus AABY01000127
atgtcccaaggtagaaaagctgcagaaagattggctaacaagaccgtgctcattacgggtgcctctgctggtattggtaaggccaccgcattagagtatttggaggcatccaatggtgatatgaaactggtcttagctgctagaagattagaaaagctcgaggaattaaagaaaactattgatcaggagtttccaaacgccaaagttcatgtggcccaactggatatcactcaagcagaaaagatcaagccctttattgagaatttgccaaaggagttcaaagacattgacattttggtgaacaacgctgggaaggcccttggtaccgaccgtgtgggggagattgcaacacaagatatccaggatgtgtttgacaccaacgtcacagctttaattaatatcactcaagctgtgctgcccatttttcaagccaagaactcaggggatattgtgaacttgggttcggtggctggcagggatgcatacccaacgggttccatctattgtgcctccaagtttgccgtgggggcgttcactgatagtttaagaaaggagcttatcaacaccaagatcagagtcatcctaatcgcaccagggctagtcgaaactgaattttcactggttagatacagaggcaacgaggagcaagccaagaatgtctacaaggacaccaccccattaatggctgatgacgtggctgatttgatcgtgtacgcaacttccaggaaacaaaacactgtaattgcagacacgctaatctttccaaccaaccaagcatcgcctcaccacatcttccgtggatga

SEQ ID NO: 699 - protein, 267 aa, Artificial Sequence
  Saccharomyces paradoxus AABY01000127
MSQGRKAAERLANKTVLITGASAGIGKATALEYLEASNGDMKLVLAARRLEKLEELKKTIDQEFPNAKVHVAQLDITQAEKIKPFIENLPKEFKDIDILVNNAGKALGTDRVGEIATQDIQDVFDTNVTALINITQAVLPIFQAKNSGDIVNLGSVAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 700 - DNA, 805 bp, Artificial Sequence
  Saccharomyces bayanus AACA01000631
atgtcccaaggtagaaaagctgcagaaagattggccaacaagacggtgctcattacaggcgcttctgctggtattggtaaggccaccgcattggagtatttggaagcatccaatggaaacatgaaactgatcttggctgcgaggagattggagaagctagaggagctgaagaagaccatcgacgaggagtttcccaatgcaaaggttcacgttggccaactggatatcacacaggccgagaagatcaagcccttcattgaaaacttgccggaggcattcaaggatattgacatcctgataaacaatgccggcaaagccctgggctccgaacgtgtcggggaaattgccacacaggacatccaggacgtgttcgacaccaacgtcacggcgttgatcaacgtcacgcaagcagtgctgccaattttccaagccaagaactcaggggacatcgtcaacttggggctcggtggccggcagagacgcataccccacaggctccatctactgtgcttccaagtttgccgtcggtgcgttcactgacagtttgagaaaggaactgatcaacacgaagatcagagttatcttgatcgcgccggggctggttgagaccgagttctcactggtcagatacagaggtaatgaggaacaagctaaaaacgtctacaaggacactacgccgttgatggccgacgacgtggctgacttaatcgtatattccacttccagaaagcagaacaccgtggttgccgacaccctgatcttccccaccaaccaagcctcgccctaccacatctttcgcggttaa

SEQ ID NO: 701 - protein, 262 aa, Artificial Sequence
  Saccharomyces bayanus AACA01000631
MSQGRKAAERLANKTVLITGASAGIGKATALEYLEASNGNMKLILAARRLEKLEELKKTIDEEFPNAKVHVGQLDITQAEKIKPFIENLPEAFKDIDILINNAGKALGSERVGEIATQDIQDVFDTNVTALINVTQAVLPIFQAKNSGDIVNLGLGGRQRRIPHRLHLLCFQVCRRCVHQFEKGTDQHEDQSYLDRAGAGDRVLTGQIQRGTSKRLQGHYAVDGRRRGLNRIFHFQKAEHRGCRHPDLPHQPSLALPHLSRL

SEQ ID NO: 702 - DNA, 804 bp, Artificial Sequence
  Saccharomyces castellii AACF01000116
atgtctcaaggtcctaaagctgccgaaagattgaatgagaagattgtgtttatcactggtgcttcagctggtattgggcaagccaccgctttggaatacatggatgcgtcgaacggtactgtgaaattggttctagttgccagaagattggagaaattacaacaattgaaggaagtcattgaggcaaaataccctaagagtaaagtctatattgggaagttggatgtgacagagcttgagaccattcaaccattcttggataatcttcctgaggaatttaaggatattgatatcttgattaataatgccgggaaggcattaggttccgatcgtgtaggtgatattgatataaaagatgtgaagggaatgatggataccaatgtcttggggttgatcaatgtgacgcaagctgtgttgcacattttccaaaagaagaactccggtgatattgtgaacttaggttcagttgctggaagagatgcatacccaacagggtccatttactgtgcttctaaatttgccgtgagggcctttactgaaagtttgagaagggaattaattaataccaagattagggtgatattgatagccccgggtatcgtcgaaactgaattctcagttgttagatacaagggtgataatgagcgtgctaaatctgtctacgatggagttcaccccttggaagcagacgacgtagcagatttaattgtatacaccacttcaagaaaacagaacacagtaattgctgacactttgatattcccaacctctcaaggttccgcattccacgtccatcgcgattaa

SEQ ID NO: 703 - protein, 267 aa, Artificial Sequence
  Saccharomyces castellii AACF01000116
MSQGPKAAERLNEKIVFITGASAGIGQATALEYMDASNGTVKLVLVARRLEKLQQLKEVIEAKYPKSKVYIGKLDVTELETIQPFLDNLPEEFKDIDILINNAGKALGSDRVGDIDIKDVKGMMDTNVLGLINVTQAVLHIFQKKNSGDIVNLGSVAGRDAYPTGSIYCASKFAVRAFTESLRRELINTKIRVILIAPGIVETEFSVVRYKGDNERAKSVYDGVHPLEADDVADLIVYTTSRKQNTVIADTLIFPTSQGSAFHVHRD

SEQ ID NO: 704 - DNA, 804 bp, Artificial Sequence
  Saccharomyces mikatae AACH01000019
atgtctcaaggtagaaaagctgcagaaagattggctggcaaaaccgttctcatcacgggtgcctctgctggtattggcaaagccactgcattagagtatttggaggcatccaatggcgatatgaaattaatcttagccgctagaagattagaaaagctcgaggaattgaagaagactatcgatgaagagtttccaaacgcaaaggtccatgtgaccaaactggacatcacacagacagaaaagatcaagccctttattgaaaacttgccagaggagttcaaagacattgatattctggtgaacaacgctggtaaggctcttggtacggaccgtgttggggagattgatacacaggacgtccaggacgtgttcgacaccaacgtctcggctttgattaatgtcacacaggctgttctgcccatcttccaagctaagaactcaggggatattgtgaacttgggctcggtagctggcagagatgcatacccaacgggctccatctattgtgcatctaagtttgccgtcggggctttcactgagagtttgagaatggaacttataaacactaagattagagtcattctaattgcaccagggttagtcgaaactgagttttccctggttagatacagaggtaacgaagaacaagccaagaatgtttacaaggacaccactccgttgatggccgatgacgtggctgatttgattgtgtatgcgacttcaaggaagcagaacactgtaattgcagacacactaatctttcctaccaaccaagcgtcaccttaccatatctttcgcgggtga

SEQ ID NO: 705 - protein, 267 aa, Artificial Sequence
  Saccharomyces mikatae AACH01000019
MSQGRKAAERLAGKTVLITGASAGIGKATALEYLEASNGDMKLILAARRLEKLEELKKTIDEEFPNAKVHVTKLDITQTEKIKPFIENLPEEFKDIDILVNNAGKALGTDRVGEIDTQDVQDVFDTNVSALINVTQAVLPIFQAKNSGDIVNLGSVAGRDAYPTGSIYCASKFAVGAFTESLRMELINTKIRVILIAPGLVETEFSLVRYRGNEEQAKNVYKDTTPLMADDVADLIVYATSRKQNTVIADTLIFPTNQASPYHIFRG

SEQ ID NO: 706 - DNA, 804 bp, Artificial Sequence
  Ashbya gossypii AE016819
atgtccctaggaagaaaagcagctgaaagattagccaacaaaattgtgcttgtgactggtgcctctgcgggcattggccgtgctacagccattaactatgcagacgcgacggacggggcaatcaagttgattttggtggcaagacgcgcagaaaagctcaccagcttgaaacaggagatcgaaagcaagtatcccaacgccaagatccatgtcggacaattggatgtgacccaactggaccagatccgcccatttttggagggactacctgaggagttccgagacattgatattttaattaacaacgcaggtaaggccctcggcactgagagggtgggggaaatctcgatggacgatatccaggaggttttcaacactaatgttatcggcttggtgcacttgactcaggaggttctacctattatgaaagccaagaattccggggacattgtcaatgttgggtcgattgccggccgcgaagcctaccctggtggctctatttactgtgccacgaaacatgcggtcaaggctttcaccagggccatgcggaaggagctcattagcaccaagatccgggtcttcgaaattgcgccgggctctgtagaaacggaattctccatggttcgtatgcgcggtaacgaagagaatgccaagaaagtgtaccagggatttgaacccctagatggtgatgatatcgctgatacaattgtctatgccacatccagaagatccaacaccgtagttgcagagatggtcgtttacccatccgcgcaaggttctctgtacgatactcaccgcaactaa

SEQ ID NO: 707 - protein, 267 aa, Artificial Sequence
  Ashbya gossypii AE016819
MSLGRKAAERLANKIVLVTGASAGIGRATAINYADATDGAIKLILVARRAEKLTSLKQEIESKYPNAKIHVGQLDVTQLDQIRPFLEGLPEEFRDIDILINNAGKALGTERVGEISMDDIQEVFNTNVIGLVHLTQEVLPIMKAKNSGDIVNVGSIAGREAYPGGSIYCATKHAVKAFTRAMRKELISTKIRVFEIAPGSVETEFSMVRMRGNEENAKKVYQGFEPLDGDDIADTIVYATSRRSNTVVAEMVVYPSAQGSLYDTHRN

SEQ ID NO: 708 - DNA, 807 bp, Artificial Sequence
  Candida glabrata CR380959
atgtctcaaggaagaaaagctgctgagaggttacaagggaagattgcctttattacgggtgcctctgcgggcatcggtaaagctacagccattgagtatttggatgcttccaatggtagtgtgaagctagttcttggtgcacgtagaatggagaaattggaggagttgaagaaggaattgctggctcaatatcctgatgcaaagattcatataggtaaactggatgttacagactttgaaaacgtcaagcagtttttggctgacttgccagaagagttcaaggacatcgacatcctgatcaataacgctggtaaagcgttggggtctgacaaagttggagacattgaccctgaggatatcgcaggaatggttaacaccaacgtccttgcattgatcaatttaacacaattgttgttgccattattcaagaagaagaacagtggtgatatcgtcaacttgggatcgattgctggtagagacgcatacccaacgggtgctatatactgtgcaacaaaacatgctgtcagggcattcacacaatccttaaggaaggaattgatcaacaccgacattagagtaattgaaattgctcctggtatggtcgaaaccgagttttctgtggtcaggtacaaaggtgacaagtccaaagcagacgacgtctacagaggtacaacaccactatatgccgatgatatcgcggatttgattgtgtactctaccagcagaaagccaaacatggtggtagcagatgtcctggtcttcccaacacaccaggcatcggcttcgcacatctacaggggcgactaa

SEQ ID NO: 709 - protein, 268 aa, Artificial Sequence
  Candida glabrata CR380959
MSQGRKAAERLQGKIAFITGASAGIGKATAIEYLDASNGSVKLVLGARRMEKLEELKKELLAQYPDAKIHIGKLDVTDFENVKQFLADLPEEFKDIDILINNAGKALGSDKVGDIDPEDIAGMVNTNVLALINLTQLLLPLFKKKNSGDIVNLGSIAGRDAYPTGAIYCATKHAVRAFTQSLRKELINTDIRVIEIAPGMVETEFSVVRYKGDKSKADDVYRGTTPLYADDIADLIVYSTSRKPNMVVADVLVFPTHQASASHIYRGD

SEQ ID NO: 710 - DNA, 813 bp, Artificial Sequence
  Debaryomyces hansenii CR382139
atgtcgtacggatctaaagctgctgaacgtgttgccaataagattgtcttaatcactggtgcttcatctggaattggtgaagcaactgccaaagaaattgcatcagccgctaatggcaatttaaaattagtgttgtgtgctagacgaaaagaaaagttggataatttatctaaagaattgactgacaaatattcatccatcaaggttcatgttgctcaactagatgtatctaagctcgagactatcaagccatttatcaatgatttaccgaaagaattctctgacgtggatgtattagtcaacaatgcaggcttggctttgggccgtgatgaagttggaaccattgacacagatgatatgttatcgatgtttcaaactaatgttttagggttaattaccatcacacaggctgttttgccaatcatgaaaaagaagaacagcggagatgttgttaatataggttcaattgctggaagagactcttaccctggaggtggaatttactgtccaactaaggcaagtgtcaagtcgttttcgcaagttttaagaaaggaattgattagcaccaagattagagttcttgaggttgaccctggtaatgttgaaactgaattttcaaatgtcagattcaagggcgatatggaaaaggcaaagctggtttacgcgggtactgaaccattattatccgaagacgtagctgaggttgtcgtattcggacttacaagaaagcaaaataccgttattgctgagacattagtcttttcaaccaatcaagccagctcatctcacttataccgtgaaagcgataaataa

SEQ ID NO: 711 - protein, 270 aa, Artificial Sequence
  Debaryomyces hansenii CR382139
MSYGSKAAERVANKIVLITGASSGIGEATAKEIASAANGNLKLVLCARRKEKLDNLSKELTDKYSSIKVHVAQLDVSKLETIKPFINDLPKEFSDVDVLVNNAGLALGRDEVGTIDTDDMLSMFQTNVLGLITITQAVLPIMKKKNSGDVVNIGSIAGRDSYPGGGIYCPTKASVKSFSQVLRKELISTKIRVLEVDPGNVETEFSNVRFKGDMEKAKLVYAGTEPLLSEDVAEVVVFGLTRKQNTVIAETLVFSTNQASSSHLYRESDK

SEQ ID NO: 712 - DNA, 810 bp, Artificial Sequence
  Scheffersomyces stipitis XM_001387479
atgtcgtttggaaaaaaagctgctgaaagacttgccaacaaaatcattcttatcaccggggcttcgtctggtattggtgaagctacagctagagagtttgcatctgctgccaatgggaatatcagattgattttgacagccagaagaaaagaaaagttggctcaattgtcagactcattgaccaaggaatttccaactatcaaaatccattctgccaaattggatgtgaccgaacatgatggcatcaagcctttcatttctggtttacccaaggatttcgccgacatcgatgtgttgatcaacaatgctggaaaagctcttggaaaagcatctgttggtgaaatcagtgacagtgatatccaaggcatgatgcaaacgaatgtcttgggactcatcaacatgactcaggctgtgattcccatttttaaggctaaaaattctggagatatcgtcaacatcggttcgattgctggaagagacccttaccctggtggatcgatctactgtgcctccaaggctgctgttaagttcttctcgcattctttgagaaaggaactcattaacaccagaatcagagttttggaagttgatccaggtgctgtgttgaccgagttctctttggttcgtttccacggtgatcagggagctgctgatgctgtttatgaaggtacccaacctttggatgcctctgatatcgcagaagttatcgtgtttggtatcaccagaaagcagaacaccgtcatagccgaaaccttggtattcccaagtcaccaggcttctgcctctcatgtttacaaggctcctaagtag

SEQ ID NO: 713 - protein, 269 aa, Artificial Sequence
  Scheffersomyces stipitis XM_001387479
MSFGKKAAERLANKIILITGASSGIGEATAREFASAANGNIRLILTARRKEKLAQLSDSLTKEFPTIKIHSAKLDVTEHDGIKPFISGLPKDFADIDVLINNAGKALGKASVGEISDSDIQGMMQTNVLGLINMTQAVIPIFKAKNSGDIVNIGSIAGRDPYPGGSIYCASKAAVKFFSHSLRKELINTRIRVLEVDPGAVLTEFSLVRFHGDQGAADAVYEGTQPLDASDIAEVIVFGITRKQNTVIAETLVFPSHQASASHVYKAPK

SEQ ID NO: 714 - DNA, 891 bp, Artificial Sequence
  Meyerozyma guilliermondii XM_001482184
atgtgcctcttaccagccggtagcactgtattatgtcatcacccagtagtgagtgtggagattaaatcctcaatcttcatgtctttcggtgccaaagccgctgaacgccttgccaacaagatcatattgatcactggggcatcgtctggtataggcgaggctaccgccagagaattcgctgctgctgccaatggaaaaattctgttgattttgaccgctcggagagaagacaaactcaagtctctctcgcaacaattgagcctcatttacccgcaaattaaaatccattctgctcgtcttgatgtctctgagttttcgtcacttaagccgttcattactgggttgccaaaggattttgctagcatcgacgttttggtgaataatgcggggaaagcattgggaagagccaatgttggtgaaatttcccaagaggaaatcaatggcatgttccataccaatgttcttgggttgataaacttaactcaggaggtgttacccatcttcaaaaagaaaaatgctggagatattgtgaacattggctcagtggccggtagagaaccttaccctggaggtgcagtatactgtgcttcaaaggcagcagttaactacttttctcattctttgagaaaggaaactatcaattccaaaatcagggtcatggaggtggatcctggggcagtagagacagagttctcgttggttcgttttggcggtgatgccgaggctgcgaaaaaggtgtatgagggaaccgagcctttgggcccagaagatattgcggaaatcattgtgtttgctgtgtcgagaaaagccaaaactgtcattgcggaaactttggtgtttcctacccatcaggctggagcagttcatgttcatagagggccgcttgagtga

SEQ ID NO: 715 - protein, 296 aa, Artificial Sequence
  Meyerozyma guilliermondii XM_001482184
MCLLPAGSTVLCHHPVVSVEIKSSIFMSFGAKAAERLANKIILITGASSGIGEATAREFAAAANGKILLILTARREDKLKSLSQQLSLIYPQIKIHSARLDVSEFSSLKPFITGLPKDFASIDVLVNNAGKALGRANVGEISQEEINGMFHTNVLGLINLTQEVLPIFKKKNAGDIVNIGSVAGREPYPGGAVYCASKAAVNYFSHSLRKETINSKIRVMEVDPGAVETEFSLVRFGGDAEAAKKVYEGTEPLGPEDIAEIIVFAVSRKAKTVIAETLVFPTHQAGAVHVHRGPLE

SEQ ID NO: 716 - DNA, 804 bp, Artificial Sequence
  Vanderwaltozyma polyspora XM_001645671
atgtcacagggtagaaaggcttcagaaaggttggctggtaaaactgtattaattacaggtgcttcatcagggattgggaaagccactgcattagaatatctagatgcctccaatggtcatatgaagttaattttagttgcaagaagattagaaaaattgcaagagttgaaggaaacaatttgtaaagaatatccagaatctaaggttcatgttgaagaattagatatttctgatattaatagaatcccagaatttattgcaaaattacctgaagaattcaaagatattgatatattgattaacaatgcaggtaaagcattaggaagtgatactattggtaatatcgagaatgaggatattaaaggtatgtttgagactaacgtttttggattaatctgtttaacacaagctgtacttccaatattcaaggctaaaaatggtggtgatattgtcaatttagggtcaattgcaggcatagaagcttacccaacaggatctatatattgtgcaactaaatttgcagttaaagcattcactgaaagtttaagaaaggaattgattaatacaaagatcagagttattgaaattgcaccaggtatggttaacactgaattttctgtaattagatataaaggtgaccaagaaaaggcagataaagtttatgaaaacactactcctttatatgcagatgacatcgctgatttgatagtttacaccacttctagaaaatcgaataccgttatcgctgatgttttggtattcccaacatgccaagcttctgcatcccatatctatcgtggataa

SEQ ID NO: 717 - protein, 267 aa, Artificial Sequence
  Vanderwaltozyma polyspora XM_001645671
MSQGRKASERLAGKTVLITGASSGIGKATALEYLDASNGHMKLILVARRLEKLQELKETICKEYPESKVHVEELDISDINRIPEFIAKLPEEFKDIDILINNAGKALGSDTIGNIENEDIKGMFETNVFGLICLTQAVLPIFKAKNGGDIVNLGSIAGIEAYPTGSIYCATKFAVKAFTESLRKELINTKIRVIEIAPGMVNTEFSVIRYKGDQEKADKVYENTTPLYADDIADLIVYTTSRKSNTVIADVLVFPTCQASASHIYRG

SEQ ID NO: 718 - DNA, 807 bp, Artificial Sequence
  Candida dubliniensis XM_002419771
atgtcatttggtagaaaagctgctgaaagattagccaatagatccattcttatcactggtgcttcatctgggattggtgaagcatgtgctaaagttttcgctgaagcatctaatggtcaagttaaattagttttaggagcaagaagaaaagaacgattagttaaattatctgatactttaattaaacaatatcctaatattaaaattcatcatgattttttggatgttactattaaagattcaatttcaaaattcattgctggaattcctcatgaatttgaacctgatgtattaattaataatagtggtaaagccttggggaaagaagaagttggagaattgaaagatgaagatattacggaaatgtttgatactaatgtcattggagtcattcgtatgactcaagcagttttacctttacttaaaaaaaaaccttatgctgatgtggttttcattggaagtattgctggacgtgttccttataaaaatggaggtggttattgtgcatctaaagctgctgttcgtagtttcaccgatacatttagaaaagaaactattaatactggtattagagtcattgaagttgatccaggtgcagtacttactgaatttagtgttgttcgttataaaggtgacactgatgctgccgatgctgtttatactggtactgaaccattaacaccagaagatgttgctgaagtggttgtttttgcatcttcaagaaaacaaaataccgttattgctgatactttgattttcccaaatcatcaagcttctccagatcatgtttatagaaaacctaattaa

SEQ ID NO: 719 - protein, 268 aa, Artificial Sequence
  Candida dubliniensis XM_002419771
MSFGRKAAERLANRSILITGASSGIGEACAKVFAEASNGQVKLVLGARRKERLVKLSDTLIKQYPNIKIHHDFLDVTIKDSISKFIAGIPHEFEPDVLINNSGKALGKEEVGELKDEDITEMFDTNVIGVIRMTQAVLPLLKKKPYADVVFIGSIAGRVPYKNGGGYCASKAAVRSFTDTFRKETINTGIRVIEVDPGAVLTEFSVVRYKGDTDAADAVYTGTEPLTPEDVAEVVVFASSRKQNTVIADTLIFPNHQASPDHVYRKPN

SEQ ID NO: 720 - DNA, 822 bp, Artificial Sequence
  Zygosaccharomyces rouxii XM_002494574
atgtcacaaggtgtcaaagctgctgaaagactagctggtaagactgtattcattacaggtgcttctgcaggtatcggtcaagcaactgcaaaggaatatttggatgcatccaatggtcaaattaaattgatcttggctgcaagaagattagagaaattacacgagtttaaagaacaaactacaaagagttacccaagcgctcaagtccacattggtaaattggacgtcactgcaattgacaccataaaaccatttttggataaattaccaaaggaatttcaagatatcgatattttgatcaacaatgccggtaaggcattaggtactgataaagttggtgatattgcagatgaagacgtggaaggtatgttcgacaccaatgtcttggggttaatcaaagttactcaagctgttttacctatcttcaaaagaaaaaattctggtgatgtcgttaacattagttcggttgctggtagagaggcatacccaggtggttccatttactgtgctactaaacacgctgttaaggcattcactgaaagtttgcgtaaggaattagtcgatacaaaaatcagagtcatgagtattgatcctggtaatgtagagaccgaattttctatggttagattccgtggtgatacagaaaaggcaaagaaggtttaccaagacactgtcccattatatgcagatgacattgcagatttaatcgtctatgcaacctctagaaagcaaaacactgtcattgctgacactttgatcttctcttctaaccaggcatcaccataccacctctacagaggctctcaagacaaaaccaattga

SEQ ID NO: 721 - protein, 273 aa, Artificial Sequence
  Zygosaccharomyces rouxii XM_002494574
MSQGVKAAERLAGKTVFITGASAGIGQATAKEYLDASNGQIKLILAARRLEKLHEFKEQTTKSYPSAQVHIGKLDVTAIDTIKPFLDKLPKEFQDIDILINNAGKALGTDKVGDIADEDVEGMFDTNVLGLIKVTQAVLPIFKRKNSGDVVNISSVAGREAYPGGSIYCATKHAVKAFTESLRKELVDTKIRVMSIDPGNVETEFSMVRFRGDTEKAKKVYQDTVPLYADDIADLIVYATSRKQNTVIADTLIFSSNQASPYHLYRGSQDKTN

SEQ ID NO: 722 - DNA, 804 bp, Artificial Sequence
  Lachancea thermotolerans XM_002553230
atgtcacagggaagaagagcagctgaaagactggcaggaaagactgtcttcatcacaggcgcatcagccggtatcggtcaggccactgcgcaagaatacctggaagcatccgaaggcaaaatcaagttgatccttgcagcaagaagactcgacaagctggaggaaatcaaagccaaggtttctaaagacttccctgaagcacaggtgcatatcggccagctagatgtgactcagacggacaaaatccagccttttgtcgacaatttgcccgaagagttcaaagacatcgacatcctgatcaacaacgcgggcaaggcgctcggatccgaccccgtgggcacaatcgaccccaatgatattcaaggcatgatccagactaacgttatcgggcttataaatgttacccaagccgttctgcccatcttcaaggccaaaaactctggtgatatcgtgaacctgggttctgtcgctggcagagaagcttaccctacaggatctatttactgcgctacgaagcacgcggtgcgtgctttcacccagagcctgcgcaaggaactgatcaacacaaacatcagggttattgaggtcgctccaggtaacgtggagaccgagttttctctggttagatacaagggcgactctgagaaagccaagaaggtttacgaaggcacacaacccctttacgctgacgatatcgcagacctaatcgtttacgcaacctcgagaaaaccaaacaccgtcatcgcggacgttttggttttcgcttcgaaccaggcttcgccttaccacatttaccgtggttag

SEQ ID NO: 723 - protein, 267 aa, Artificial Sequence
  Lachancea thermotolerans XM_002553230
MSQGRRAAERLAGKTVFITGASAGIGQATAQEYLEASEGKIKLILAARRLDKLEEIKAKVSKDFPEAQVHIGQLDVTQTDKIQPFVDNLPEEFKDIDILINNAGKALGSDPVGTIDPNDIQGMIQTNVIGLINVTQAVLPIFKAKNSGDIVNLGSVAGREAYPTGSIYCATKHAVRAFTQSLRKELINTNIRVIEVAPGNVETEFSLVRYKGDSEKAKKVYEGTQPLYADDIADLIVYATSRKPNTVIADVLVFASNQASPYHIYRG

SEQ ID NO: 724 - DNA, 807 bp, Artificial Sequence
  Kluyveromyces lactis XM_451902
atgtctcaaggtagaaaggctgctgaaagattgcaaaacaagacaattttcattaccggtgcttctgcaggtattggtcaagccacagcattggaatatctagatgctgctaacggtaatgtcaaattgatcttagcagcaagaaggttggctaagttggaagaattgaaggaaaaaatcaatgctgaatacccacaagctaaagtatatatcggtcaattggacgtcactgaaactgagaagattcaacctttcattgataacttgccggaagaattcaaggatatcgatattttgattaacaatgccggtaaagctttgggatctgatgttgtcggtaccatcagtagcgaggacatcaaaggtatgatagatactaacgttgttgcccttatcaacgttacccaagctgttttgcctattttcaaagcaaagaattccggtgacatcgttaacttaggttctgttgccggtagagatgcatatccaactggttctatctattgtgcttcgaagcatgctgtcagagcgttcactcagtctttgagaaaagaattaatcaatactggtattagggtcattgagattgctccaggtaatgtcgaaactgagttctctctagttagatacaagggtgatgccgatcgtgctaaacaggtttacaaaggtactactcctctatatgcagatgacattgctgacttgatcgtttatgccacttcaagaaaacctaatactgtcatcgctgatgttttggtatttgcttccaaccaagcatctccttaccacatttaccgtggcgaatag

SEQ ID NO: 725 - protein, 268 aa, Artificial Sequence
  Kluyveromyces lactis XM_451902
MSQGRKAAERLQNKTIFITGASAGIGQATALEYLDAANGNVKLILAARRLAKLEELKEKINAEYPQAKVYIGQLDVTETEKIQPFIDNLPEEFKDIDILINNAGKALGSDVVGTISSEDIKGMIDTNVVALINVTQAVLPIFKAKNSGDIVNLGSVAGRDAYPTGSIYCASKHAVRAFTQSLRKELINTGIRVIEIAPGNVETEFSLVRYKGDADRAKQVYKGTTPLYADDIADLIVYATSRKPNTVIADVLVFASNQASPYHIYRGE

SEQ ID NO: 726 - DNA, 807 bp, Artificial Sequence
  Saccharomyces kluyveri SAKL0H04730
atgtctcaaggtagaagggctgcagaaagactagcaaacaagaccgtttttataactggcgcctctgccggcattggccaagctactgctttggaatactgtgatgcttctaacggtaaaataaacttggtgttaagtgccagaaggctggaaaaattgcaagagttaaaggacaaaatcaccaaggagtatcctgaagccaaggtttatattggtgtgcttgatgtgaccgaaacggaaaaaatcaaaccattcttggatggtttaccagaagaatttaaagatattgacatcttgatcaataatgcaggcaaagcgttaggctctgatcctgttggtaccatcaaaactgaagatattgaaggaatgatcaacaccaatgtcttagctcttatcaatattactcaagctgtcttgccaatcttcaaagccaagaatttcggtgatatcgtaaacttggggtctgtcgctggtagagatgcttatccaaccggtgcaatctactgtgctagcaaacatgcagtcagagccttcactcaaagtttgaggaaggaattggtgaacaccaatatcagagtgattgaaattgctccgggtaatgttgaaaccgagttttccttagttagatataaaggtgatacggaccgtgctaaaaaggtttatgaaggtactaacccattatatgcagatgacattgcagaccttattgtgtatgctacttctagaaagcctaatactgtcattgcggatgttttggtttttgcttcaaaccaagcatccccttaccatatctatcgcggtgactaa

SEQ ID NO: 727 - protein, 268 aa, Artificial Sequence
  Saccharomyces kluyveri SAKL0H04730
MSQGRRAAERLANKTVFITGASAGIGQATALEYCDASNGKINLVLSARRLEKLQELKDKITKEYPEAKVYIGVLDVTETEKIKPFLDGLPEEFKDIDILINNAGKALGSDPVGTIKTEDIEGMINTNVLALINITQAVLPIFKAKNFGDIVNLGSVAGRDAYPTGAIYCASKHAVRAFTQSLRKELVNTNIRVIEIAPGNVETEFSLVRYKGDTDRAKKVYEGTNPLYADDIADLIVYATSRKPNTVIADVLVFASNQASPYHIYRGD

SEQ ID NO: 728 - DNA, 807 bp, Artificial Sequence
  Yarrowia lipolytica XM_501554
atgtctttcggagataaagctgctgctcgacttgcgggcaagaccgtctttgttaccggcgcctcgtccggcattggccaggccactgttctcgctctagccgaagctgccaagggcgacctcaagtttgtgcttgctgcccgacgaaccgaccgtctggacgagctcaagaagaagctggagaccgactacaagggtatccaggtgctgcctttcaagctggacgtgtccaaggtcgaggagaccgagaacattgtgtccaagctgcccaaggagttttccgaggtggacgtgcttatcaacaacgccggcatggtccacggcaccgaaaaggttggctccatcaaccagaacgacattgagatcatgttccacacaaacgtgctcggactcatttctgtcactcagcagtttgtcggcgagatgcgaaagcgaaacaagggcgacattgtcaacattggctccatcgccggacgagagccctacgttggaggaggaatctactgtgccaccaaggccgccgtgcgatctttcactgagactctccgaaaagagaacatcgacactcgaatccgagtcattgaggttgatcctggagccgttgagaccgagttctccgtcgtgcgattccgaggagacaagtccaaggccgacgctgtttacgctggaaccgagcctctggtcgctgacgatattgccgagttcatcacctacactctcactcgacgagagaatgtcgtcattgccgatactctcattttccccaaccaccaggcttctcctactcacgtctaccgaaagaactga

SEQ ID NO: 729 - protein, 268 aa, Artificial Sequence
  Yarrowia lipolytica XM_501554
MSFGDKAAARLAGKTVFVTGASSGIGQATVLALAEAAKGDLKFVLAARRTDRLDELKKKLETDYKGIQVLPFKLDVSKVEETENIVSKLPKEFSEVDVLINNAGMVHGTEKVGSINQNDIEIMFHTNVLGLISVTQQFVGEMRKRNKGDIVNIGSIAGREPYVGGGIYCATKAAVRSFTETLRKENIDTRIRVIEVDPGAVETEFSVVRFRGDKSKADAVYAGTEPLVADDIAEFITYTLTRRENVVIADTLIFPNHQASPTHVYRKN

SEQ ID NO: 730 - DNA, 780 bp, Artificial Sequence
  Schizosaccharomyces pombe NM_001018495
atgagccgtttggatggaaaaacgattttaatcactggtgcctcttctggaattggaaaaagcactgcttttgaaattgccaaagttgccaaagtaaaacttattttggctgctcgcagattttctaccgttgaagaaattgcaaaggagttagaatcgaaatatgaagtatcggttcttcctcttaaattggatgtttctgatttgaagtctattcctggggtaattgagtcattgccaaaggaatttgctgatatcgatgtcttgattaataatgctggacttgctctaggtaccgataaagtcattgatcttaatattgatgacgccgttaccatgattactaccaatgttcttggtatgatggctatgactcgtgcggttcttcctatattctacagcaaaaacaagggtgatattttgaacgttggcagtattgccggcagagaatcatacgtaggcggctccgtttactgctctaccaagtctgcccttgctcaattcacttccgctttgcgtaaggagactattgacactcgcattcgtattatggaggttgatcctggcttggtcgaaaccgaattcagcgttgtgagattccacggagacaaacaaaaggctgataatgtttacaaaaatagtgagcctttgacacccgaagacattgctgaggtgattctttttgccctcactcgcagagaaaacgtcgttattgccgatacacttgttttcccatcccatcaaggtggtgccaatcatgtgtacagaaagcaagcgtag

SEQ ID NO: 731 - protein, 259 aa, Artificial Sequence
  Schizosaccharomyces pombe NM_001018495
MSRLDGKTILITGASSGIGKSTAFEIAKVAKVKLILAARRFSTVEEIAKELESKYEVSVLPLKLDVSDLKSIPGVIESLPKEFADIDVLINNAGLALGTDKVIDLNIDDAVTMITTNVLGMMAMTRAVLPIFYSKNKGDILNVGSIAGRESYVGGSVYCSTKSALAQFTSALRKETIDTRIRIMEVDPGLVETEFSVVRFHGDKQKADNVYKNSEPLTPEDIAEVILFALTRRENVVIADTLVFPSHQGGANHVYRKQA

SEQ ID NO: 732 - DNA, 1521 bp, Artificial Sequence
  ALD2 from S. cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggaaagccttaccattcaaatgccaaaggtgatttggcacaaattttacagcttaccagatattttgctgggtccgctgataagtttgacaaaggtgcaaccataccattgacttttaacaagtttgcatatactctaaaagttccttttggcgttgttgctcaaatcgttccatggaattatcctctagctatggcttgttggaaattgcaaggtgccttagcagccggtaacacggttatcatcaaacctgctgagaatacctctctatctctactttattttgctactttaattaaaaaagcaggttttccacctggtgttgtcaatatcgttcctggttatggatcacttgtaggccaagccctagcatctcacatggatatcgacaaaatatcttttacgggaagcaccaaggtcggtggatttgtgttggaagcttccggccaatcgaaccttaaagacgttacactagaatgcggtggtaagtctcctgctctcgtatttgaagatgcagaccttgataaggctatcgattggatagcagctggcattttctacaattcaggacagaattgtaccgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaagggaggaaaagttggacatgttccagacctctgaatttcctattggtggagctaaaggctacttcattcccccaaccatcttcactgatgtcccgcaaacatcgaaactgttacaggatgagatatttggcccggttgtggttgttagcaagttcacaaattatgatgacgctctgaagctggctaatgatacttgctacgggctcgcctctgcggtcttcacaaaagatgtcaagaaagcgcacatgtttgctcgcgatattaaagcaggaactgtttggatcaactcatctaacgatgaagatgttaccgttccttttggcgggtttaaaatgagtggtattggtagagaactggggcaaagtggtgttgatacctatcttcaaacaaaagcagttcacataaatctctctttggacaactaa

SEQ ID NO: 733 - protein, 506 aa, Artificial Sequence
  ALD2 from S. cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 734 - DNA, 1521 bp, Artificial Sequence
  ALD3 from S. cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggtaagcctttccattccaatgctaaacaagacttagcccagattatagaacttacaagatactatgcgggggcggtcgacaagttcaatatgggtgaaaccattccattgacttttaacaagtttgcatatactctaaaagttccttttggcgttgttgctcaaatcgttccatggaattatcctctagctatggcttgtagaaaaatgcaaggtgccttagcggccggtaacacggttatcatcaaacctgctgaaaatacctctctatctctactttattttgctactttaattaaaaaagcaggttttccacctggtgttgtcaatgtcattcctggttatggttccgttgtggggaaagctttaggaacccacatggatatcgacaaaatatcttttacgggaagtactaaggttggcggctcagtattggaagcttccggccaatcgaaccttaaggatatcacactagaatgcggtggtaagtctcctgctcttgtatttgaagatgcagaccttgataaggctatagaatgggtagcaaatggtattttttttaattcgggacagatctgcactgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaaaggaggaaaagttggacatgttccagacctctgaatttcctattggtggagctaaaggctacttcattcccccaaccatcttcactgatgtaccagaaacatctaagttgctgcgtgatgaaatatttggcccggttgtggttgttagcaagttcacaaattatgatgacgctctgaagctggctaatgatacttgctacgggctcgcctctgcggtcttcaccaaagatgtcaagaaagcgcacatgtttgctcgcgatattaaagcaggaactgtttggatcaatcaaaccaatcaagaagaagctaaagttccttttggcggatttaagatgagtggtattggtagagaatcaggcgacaccggcgttgataactatttacaaataaaatcagtccatgtggatctttcattggataaataa

SEQ ID NO: 735 - protein, 506 aa, Artificial Sequence
  ALD3 from S. cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 736 - DNA, 1560 bp, Artificial Sequence
  ALD4 from S. cerevisiae
atgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaa

SEQ ID NO: 737 - protein, 519 aa, Artificial Sequence
  ALD4 from S. cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 738 - DNA, 1563 bp, Artificial Sequence
  ALD5 from S. cerevisiae
atgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaatccatctaacgaagaaaagataacaactgtatacaaggctatggaagatgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacaggtaaaaaccattttacctactcaattaaggaaccattaggcgtttgcggccaaataatcccttggaacttccctttattgatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatctagataaagccgtcaagaacattgccttcggtattttttacaactctggtgaagtttgctgcgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaaggagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttga

SEQ ID NO: 739 - protein, 520 aa, Artificial Sequence
  ALD5 from S. cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKGDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 740 - DNA, 1503 bp, Artificial Sequence; identical to SEQ ID NO: 682
  ALD6 from S. cerevisiae

SEQ ID NO: 741 - protein, 500 aa, Artificial Sequence; identical to SEQ ID NO: 279
  ALD6 from S. cerevisiae

SEQ ID NO: 742 - DNA, 1569 bp, Artificial Sequence
  KLLA0F00440 from Kluyveromyces lactis
atgttattacgtactaccactgctggtactagactagctttcaagtcacaaactgcggcattcgcacatgctttacgttactattcgcatttaccattgaaggtcaaggttgatttgccaaatggtatttcatacgaacaaccaactggtttgttcatcaataaccaatttgttccttccaagcaagggaagacttttgaagtgttgagtccttcaaccgaagaagaaattactcatgtttacgaaggtcgggaggaagacgtggatgcggctgttgaggctgcagacaaagctttcaagtccggtgtctggtctaaggttgacccactagtcagatctcagtgtttgagcaagttagctgattacattgaaaaggatttggataccattgcttctatcgaatctctggacaatggtaaagctatctcatctgctaaaggtgatgttcaactagttgttaactacctaagatcagctgctggctacgctgataaggtggatggtagagtcattgatactggttcgactcatttctcttacacagttagagaaccattaggtgtctgtggtcaaattatcccatggaacttcccattgttgatgtgggcttggaagattgctccagctcttgctaccggtaatactgttgtcttgaagaccgctgaatccacacctttgtctgcactatacgtttctcaatacattccaaaagcgggtatcccagacggtgttgtgaacatcgtttctggtttcggtaaaattgttggtgaggctattacaactcatccaaagattaagaaggttgcattcactggttccactgctactggtcgtcatatctaccaaaatgccggtgtcaatttgaagaaggtcacattggagctaggtggtaagtcaccaaacgttgttttcgctgatgcaaacttgaaatccgctgttcaaaactctttgttgggtatctactataactccggtgaagtctgctgtgctggttccaggttgtatgttgaagaatctatttatgacgatttcttgaaggaaattaagtctgcttcagaagctctaaaggttggtgatcctttcgatgcagaaactttccagggtgctcaaacttcgcaaaatcaattggacaagatcttgaaatatgtggagattggtaagaatgaaggtgctactttaattactggtggtgaaagaattggtgacaagggttactttgttagaccaactattttcgctgatgttgaagaaagcatgagaatcgttaaggaagaaatcttcggccctgttgtcactgtcaccaagtttaaaaccattgatgaattgattgaaaaggccaacgactctgaatatggattggctgcaggaattcacacatctaacatcaatactgccatccaggtttcaaacagattgaatgctggtaccgtctggattaacacatacaacgacttccaccactgtgttccgttcggtggtttcaatgcttctggtattggtagagaaatgggttctgaagctctagacaattacactcaagtcaaggctgtccgtgttaaattggagtaa

SEQ ID NO: 743 - protein, 522 aa, Artificial Sequence
  KLLA0F00440 from Kluyveromyces lactis
MLLRTTTAGTRLAFKSQTAAFAHALRYYSHLPLKVKVDLPNGISYEQPTGLFINNQFVPSKQGKTFEVLSPSTEEEITHVYEGREEDVDAAVEAADKAFKSGVWSKVDPLVRSQCLSKLADYIEKDLDTIASIESLDNGKAISSAKGDVQLVVNYLRSAAGYADKVDGRVIDTGSTHFSYTVREPLGVCGQIIPWNFPLLMWAWKIAPALATGNTVVLKTAESTPLSALYVSQYIPKAGIPDGVVNIVSGFGKIVGEAITTHPKIKKVAFTGSTATGRHIYQNAGVNLKKVTLELGGKSPNVVFADANLKSAVQNSLLGIYYNSGEVCCAGSRLYVEESIYDDFLKEIKSASEALKVGDPFDAETFQGAQTSQNQLDKILKYVEIGKNEGATLITGGERIGDKGYFVRPTIFADVEESMRIVKEEIFGPVVTVTKFKTIDELIEKANDSEYGLAAGIHTSNINTAIQVSNRLNAGTVWINTYNDFHHCVPFGGFNASGIGREMGSEALDNYTQVKAVRVKLE

SEQ ID NO: 744 - DNA, 1524 bp, Artificial Sequence
  KLLA0E23057 from Kluyveromyces lactis
atgtcctctacaattgctgagaaattgaacctcaagatcgtcgaacaagacgctgttagcatcactttgccaaacggtttgacttaccaacaaccaactggtttgttcatcaacaatcagttcatcaagtctcaagacggtaagactttgaaggttgaaaacccatctactgaggaaatcattgtcgaagtccaatctgctacttctcaagacgtcgagtacgccgttgaagctgccgatgctgctttcaactccgaatggtctactatggacccaaaaaagcgtggttctttgttgtttaagttggctgacttgattgaagctcaaaaggaattgattgcttctatcgaatctgctgacaacggtaagactttggccctagccagaggtgatgttggtttggtcattgactacatcagatctgctgctggttatgctgacaagttgggtggtagaactatcaacactggtgatggttacgctaacttcacttacaaggaacctctaggtgtctgtggtcaaatcatcccatggaacttcccattgatgatgctttcttggaagatcgcccctgctttggttgctggtaacaccgttatcttgaagccagcttccccaaccccattgaacgctttgttctttgcttctttgtgtaaggaagcaggtatcccagctggtgtcgttaacatcgttccaggtccaggtagatccgttggtgacaccatcaccaaccatccaaaaattagaaagattgccttcactggttccactgacattggtagagacgttgctatcaaggctgcccaatctaacttgaagaaggtcaccttggaattgggtggtaaatccgctcatttggtctttgaagatgccaacattaagaagactattccaaacttggtcaacggtattttcaagaatgctggtcaaatttgttcctctggttccagaatctatgtccaagacaccatctacgatcaactattgtctgaattcaagacttacctggaaactgaaattaaggtcggttccccattcgatgaatctaacttccaagctgctatcaacaacaaggctcaattcgaaactatcttgaactacatcgacatcggtaagaaggaaggtgcttctatcttgactggtggtgaaagagtaggcaacaagggttacttcattaaaccaactgtattctacaacgttaaggaagatatgagaatcgtcaaggaagaaatctttggtcctgtcgtcaccatctccaagttctctactgtcgacgaagctgtcgctttggctaacgactccgaattcggtttgggtgctggtatcgaaactgaaaacatctccgttgccttgaaggtcgcaaagagactaaaagctggtaccgtctggatcaacacttacaacgatttcgacgctgccgttccattcggtggttacaagcaatctggttacggtagagaaatgggtgaagaagctttcgaatcttacactcaaatcaaggccgtcaggatcaagttggattaa

SEQ ID NO: 745 - protein, 507 aa, Artificial Sequence
  KLLA0E23057 from Kluyveromyces lactis
MSSTIAEKLNLKIVEQDAVSITLPNGLTYQQPTGLFINNQFIKSQDGKTLKVENPSTEEIIVEVQSATSQDVEYAVEAADAAFNSEWSTMDPKKRGSLLFKLADLIEAQKELIASIESADNGKTLALARGDVGLVIDYIRSAAGYADKLGGRTINTGDGYANFTYKEPLGVCGQIIPWNFPLMMLSWKIAPALVAGNTVILKPASPTPLNALFFASLCKEAGIPAGVVNIVPGPGRSVGDTITNHPKIRKIAFTGSTDIGRDVAIKAAQSNLKKVTLELGGKSAHLVFEDANIKKTIPNLVNGIFKNAGQICSSGSRIYVQDTIYDQLLSEFKTYLETEIKVGSPFDESNFQAAINNKAQFETILNYIDIGKKEGASILTGGERVGNKGYFIKPTVFYNVKEDMRIVKEEIFGPVVTISKFSTVDEAVALANDSEFGLGAGIETENISVALKVAKRLKAGTVWINTYNDFDAAVPFGGYKQSGYGREMGEEAFESYTQIKAVRIKLD

SEQ ID NO: 746 - DNA, 1512 bp, Artificial Sequence
  KLLA0D10021 from Kluyveromyces lactis
atgtcctttaccagcatcaaactagcagatggtactgagtaccaacaacctttaggtttattcattaacaatgaatatgttgaagcacatggttcggagactttaacatcatataacccaagttctggtgaagaaatctgcaaagttcaatgtgcagacccaaagattgatgtcgatttggctgttaaggctgcaagagacgcttttcctggttggaaagcgactccagctatagaaaagagagacttgttctacaaattggccggcttgttggaaagagatattgacatattaagtaaaatcgagtccctggacactggaaagccaattgccaacaatgccaagtacgacatactagaagtggttgaggtcttaaagtactatgctggatggatcgataaggcaggtggtcaatctttcgctccaagcagtgaaaagttagcttatactttacatcagccattaggcgtggttggatgtattatcccattcaactatccattggctatgatgtcttggaaatggactgctatcgccactgggaacacaactgtttttaaatctgcggatcagactccattatccatcctatatttcgccaaattggtgaaggaagcagggttccctgcaggtgttttcaatgtcttatccggtacaggtgcctctgttggtagtgccattgttaaacacactggtgtagacaagattgcattcacaggttccactgcagttggtcaaattatccaacaacaatctgcagtaaacttgaaacctatcacattggaatgtggtggtaaatctgcgaacatgatctttgaagattgtgatttagaacaggccgtgaaatggagtgcatggggtattttcaacaatatgggtcaaatctgttccggtacttcaagagtcttcgtgcaagaatctatttacgaggaatttgtagcacaattggctgaccatgtcaagaaaacttatatcgtgggtgctccttcagatgatgccgtcatcgtcggacctcaagtctccaaaaaacaacaagaacgtgtccttgaatacattaagatcggtatcgaagaaggatgcaaagtgccattgggtggtcttggagcacctgagccaattgcgaatgatccagcattagctaacggttactacgtcaagccaaccattttagcagatgtcaaagcgtcgtacagaatcgccaaggaagaaatctttggtcccgtcatagtcgtaggctctttcaaggactacaaagaagctttagacattgccaacgattcagactacggtcttggttcggcaattttctcaaaagacatcgtaacatgtcacaaatttgcccaggacgtggaagcaggtatggtctggatcaactcttctaacgatgttgacatcaacgtcccattcggtggtgtaaaaatgtccggtcatggccgtgaattaggtgaatacggtttagctaacttcactaacgttaaatcagttcatgttaacctaggaagaaagttgtaa

SEQ ID NO: 747 - protein, 503 aa, Artificial Sequence
  KLLA0D10021 from Kluyveromyces lactis
MSFTSIKLADGTEYQQPLGLFINNEYVEAHGSETLTSYNPSSGEEICKVQCADPKIDVDLAVKAARDAFPGWKATPAIEKRDLFYKLAGLLERDIDILSKIESLDTGKPIANNAKYDILEVVEVLKYYAGWIDKAGGQSFAPSSEKLAYTLHQPLGVVGCIIPFNYPLAMMSWKWTAIATGNTTVFKSADQTPLSILYFAKLVKEAGFPAGVFNVLSGTGASVGSAIVKHTGVDKIAFTGSTAVGQIIQQQSAVNLKPITLECGGKSANMIFEDCDLEQAVKWSAWGIFNNMGQICSGTSRVFVQESIYEEFVAQLADHVKKTYIVGAPSDDAVIVGPQVSKKQQERVLEYIKIGIEEGCKVPLGGLGAPEPIANDPALANGYYVKPTILADVKASYRIAKEEIFGPVIVVGSFKDYKEALDIANDSDYGLGSAIFSKDIVTCHKFAQDVEAGMVWINSSNDVDINVPFGGVKMSGHGRELGEYGLANFTNVKSVHVNLGRKL

SEQ ID NO: 748 - DNA, 1506 bp, Artificial Sequence
  KLLA0D09999 from Kluyveromyces lactis
atgtcattgtacgaaacggttaacattccacagttgaacattacatatgagcagccattggggttgttcatcaacaacgagtttgtcaagtccagtgacggtaagaaaattgaaagcatcaacccaagtactgaggaatcgattgtctctttttttgcagcttctgaaaaagatgtcaatagtgctgttacagcagcaagagatgcttttgaaaacaattggtccaagacatcaggcgaacagagaggaattcttttgtcgaagttatttgatttgattgagagagataagttattgctagctgcgattgagacgttagattcggggaagccttaccactctaatagtcttgctgatcttgaacaaatcttgcaattaactcgttactatgctggcggtgctgataagttcaccggaggggaatatattccattaaaccaagacaagtatgcgtataccatgaaggtaccttatggtgttgttgcacaaattgttccatggaattatcccttggctatggctagctggaaaatccaatcgtgtttggctgctggtaacactattgttatcaagccagcagagaacacttctttgtctttgctttacttcgcacaacttgtcaaagaggctggctttcctccaggtgtgttgaatatcttaccaggttatggttccgttacgggaactgcaatggctagccacactgacatagacaagattgcgtttactggttcgaccgctgttggacaaaaagtcatgtcacttgctgcccaatcaaacttgaaagctgttactttggaatgcggtggtaagtctccatgtctaatttttgctgatgccaaccttgatgaagccattccttgggttgctggaggtatcttctataactcagggcagaattgtacagcaaactcgaggatctacgtccacgaggatatttacgaagagtttttaactaaatttgaagaatacgctaaatcaaactggaagttcggagctaaattcgatcctttcgataaagactgtactctagggcctgttatttcaaaagtccaatatgatcgtatccaatcctatgttgaacatggtaaagcctctgagaaactaggcttcaaggagtttgccgaatatccttctaagggttattttatcccacctactatattttcagatgttccaaactcttcgaaactctctcaagaagaaatttttggaccggtgggtgttgtggcatcattttcaacttatgaggaagccatcaagttggcaaatgactcctcttacggtttggcttcttgtgttttctctgaaaatgcccgaacaacagcacaatttgctcgcgatattagggcaggtaccgtttggatcaattcttccaatgacgaagaaatttctgttccatttggtgggttcaaaatgtccggtattggtcgtgaattggggcgtaacggtgttgactcttatttgcaaacaaaagctgttcacgtaaatattgcaaagctgtga

SEQ ID NO: 749 - protein, 501 aa, Artificial Sequence
  KLLA0D09999 from Kluyveromyces lactis
MSLYETVNIPQLNITYEQPLGLFINNEFVKSSDGKKIESINPSTEESIVSFFAASEKDVNSAVTAARDAFENNWSKTSGEQRGILLSKLFDLIERDKLLLAAIETLDSGKPYHSNSLADLEQILQLTRYYAGGADKFTGGEYIPLNQDKYAYTMKVPYGVVAQIVPWNYPLAMASWKIQSCLAAGNTIVIKPAENTSLSLLYFAQLVKEAGFPPGVLNILPGYGSVTGTAMASHTDIDKIAFTGSTAVGQKVMSLAAQSNLKAVTLECGGKSPCLIFADANLDEAIPWVAGGIFYNSGQNCTANSRIYVHEDIYEEFLTKFEEYAKSNWKFGAKFDPFDKDCTLGPVISKVQYDRIQSYVEHGKASEKLGFKEFAEYPSKGYFIPPTIFSDVPNSSKLSQEEIFGPVGVVASFSTYEEAIKLANDSSYGLASCVFSENARTTAQFARDIRAGTVWINSSNDEEISVPFGGFKMSGIGRELGRNGVDSYLQTKAVHVNIAKL

SEQ ID NO: 750 - DNA, 1506 bp, Artificial Sequence
  ALD2 from Pichia stipits
ctacaacttgttgcccaagttaacgtgaatggcctttgcctgggtgtagatggacaatccgtattcacccaattctctacctacaccagacatcttgacaccaccgaatggaatgtggacatcagagtcgttggaagagttgatccacaccataccagcttgtatttcagcagccatagtgtgggccacggtgatgtccttggtgaagatggcagcacccaaaccgtattgggtctggttggcgtaagtgatgacttcttcgtctgacgagaacttacccaccactacaacagggccaaatatttcctcgttgacgattctcatctcaggcttgatgtcagcaaaaatagttggcttgatgtagaatcctttggataattcaccctccgagttcttttcacctcccaaaagcaagcgggcaccttctttcttaccgatttcgatgtagctcaacactttatcacgctgaaccttcgaaacttgtggaccaacgactgcttcagaatcgaacatactaccctgtttgtaggcttctttcacgtgtgcagtgtattcctccaagaacttgtcgtagacagattcgtgaacgtacactctggaagtggacgtacagatctgaccttggttactcatgataccgatggcagcccacttgacagcttgttccaagtcagcgtcttcacggatgatcaaaggcgacttaccaccacactctaaggtcacagccttcaagttagaagcagcagcctgttgtataagcttaccagtagcagtagaaccagtgaaagcgatcttgtcgacatctaaatgggatgaaagagccttaccggcaacagcaccgaagccggagatgatgttaaccacaccggctgggaaaccagcgtccttgaagaggcgagctacgtacaagagagacaatggtgtaatttctgaagttttcaacacaactacgttaccagcagccaaagctggagccaacttccaggctgccatagccaatgggtagttccatgggatgatctgaccacaaacaccaagtggttcatggatggtgtaggccaacttctttggatcgttctggatcaccttaccctggattttgtcagcccagccagcaaagtatctgaaacaactgatacattcgtcaatatcgtatacggcgttttgttccttggtcttaccagagtcccaggcttcaatggcaccaatcaagtctctttgggcttcaaaggcatcagcgaccttgttcaacaagattcctctgtccacaccggtgaccttcttccagtccttaaatgcggctctggcagccttgacggcgatatcgacatcttcttcctcggcacagtaaacggtaccattgacttcactggtagatgggttgatggagtccaacgtctttccggaaacagacttgacaaactcgttgttgatgaacaaaccagtaggctgtgtgaatgtgttgccgtctggaagggtaaccaggtattctaatgggagagacat

SEQ ID NO: 751 - protein, 501 aa, Artificial Sequence
  ALD2 from Pichia stipits
MSLPLEYSVTLPDGNTFTQPTGLFINNEFVKSVSGKTLDSINPSTSEVNGTVYCAEEEDVDIAVKAARAAFKDWKKVTGVDRGILLNKVADAFEAQRDLIGAIEAWDSGKTKEQNAVYDIDECISCFRYFAGWADKIQGKVIQNDPKKLAYTIHEPLGVCGQIIPWNYPLAMAAWKLAPALAAGNVVVLKTSEITPLSLLYVARLFKDAGFPAGVVNIISGFGAVAGKALSSHLDVDKIAFTGSTATGKLIQQAAASNLKAVTLECGGKSPLIIREDADLEQAVKWAAIGIMSNQGQICTSTSRVYVHESVYDKFLEEYTAHVKEAYKQGSMFDSEAVVGPQVSKVQRDKVLSYIEIGKKEGARLLLGGEKNSEGELSKGFYIKPTIFADIKPEMRIVNEEIFGPVVVVGKFSSDEEVITYANQTQYGLGAAIFTKDITVAHTMAAEIQAGMVWINSSNDSDVHIPFGGVKMSGVGRELGEYGLSIYTQAKAIHVNLGNKL

SEQ ID NO: 752 - DNA, 1434 bp, Artificial Sequence
  ALD3 from Pichia stipitis
atgtccgctattagtagaacattccccagtattatcgagggaaaggatttccacagcaatgaaaaacatccagtatactcccatgtcacccagaaagaagcaatccactatttctcctacttaactgatatcaagaaggcagtttcgaaaatcgctgctgatgctgacgaagggtttgaagaatggtcgtccatggcctatcaagaaagagtgaagattttcgagaaggctgctgctttacttgctgaaagaagagaagagttgatagcttctcacaaaaatatcggaggtcctacctggttttcccatgtgaatgctgatgaaatcatctcgcaattgaaggaatatacttcacttctctctagacctactggtttagtagcccaatctgctcattctgatctcgcactcgtcgtcaagcagccactaggtcctgtcctcgccattgctccctggaacgctcctgttcttttggcaggtagagccatagtggctccgttggctgcgggctgttcggtcatcctaaaagcttctgaaaaggctccagaatccgcataccttgttgtgaagaccttcattgatgctggtatcccgtcaaaagcattgcaattggtcttcatcaaaccagatgacaatccagaattcatcaactccatcttggacactggtttgatcaaaaaggtcaacttcactggctctacaatcgtgggcaagaagatcgctgaagctgccagtaaacacttagtaccatatcttatggaattaggcggaaagaatgtgtctattgttgaaaaggatgctgacttggtgagggccgttgaaactataatctggagttcgtggtcgcacaaaggtcaaatatgcatgagtactgacaaggtcttcgttgatgaaagcatctacgacaaattcgttgctcaattaaaagtatccgccaatgagatcgtcaaggaccccgactacgcaatttctcaaagagatattacattcaagagaaaccttgttaagttggttaagaatgcattagatttgggtgcaaatttgatatttggtaaattaaatgaccatttggacagcggttccttcagtccattgatcttggaaaatgtcacttcaaacatgttgcttgattctaccgaatcattcggacctttgttcgctgtatataagtattcagatacaatcaaacttgtcaaggaattaaacagagctgattatggattgaaggcctcaatttggtcccaaaatgttttgcaagcattggaaacagctaaaaaaatccacgtaggtggtgtacatatcaatagttctacgattcacgacgaagcgactctaccacatggcggtgttaagtcaagtggtgctggaagattcaactccatatggggtattgacgatttttccattaccaagacaattactcttagtcagtaa

SEQ ID NO: 753 - protein, 477 aa, Artificial Sequence
  ALD3 from Pichia stipitis
MSAISRTFPSIIEGKDFHSNEKHPVYSHVTQKEAIHYFSYLTDIKKAVSKIAADADEGFEEWSSMAYQERVKIFEKAAALLAERREELIASHKNIGGPTWFSHVNADEIISQLKEYTSLLSRPTGLVAQSAHSDLALVVKQPLGPVLAIAPWNAPVLLAGRAIVAPLAAGCSVILKASEKAPESAYLVVKTFIDAGIPSKALQLVFIKPDDNPEFINSILDTGLIKKVNFTGSTIVGKKIAEAASKHLVPYLMELGGKNVSIVEKDADLVRAVETIIWSSWSHKGQICMSTDKVFVDESIYDKFVAQLKVSANEIVKDPDYAISQRDITFKRNLVKLVKNALDLGANLIFGKLNDHLDSGSFSPLILENVTSNMLLDSTESFGPLFAVYKYSDTIKLVKELNRADYGLKASIWSQNVLQALETAKKIHVGGVHINSSTIHDEATLPHGGVKSSGAGRFNSIWGIDDFSITKTITLSQ

SEQ ID NO: 754 - DNA, 1434 bp, Artificial Sequence
  ALD4 from Pichia stipitis
atggcaactgcttcaacaactttctcgagcattatcgaaggtaaggttttctacactgaaggaaaacatcctgtctactcacacgataaccatgaggaaataattcaccacttttcttacttgactgacatcaagaagtcagtcccccaaattgcagctgcagctgagcaaggttttgaggaatggtcatccttcgcatatgcagaaaaagtgaagatttttgacaaagctgctatcttgcttactgaaaggagagacgaattgatcgcctcgcacaagaacatcggaggtcctacatggttctctcacgtcaacgcagatgagtccgtctcacaattgaaggaatacactggacttctctcaagacctacgggtgttgtagctcagtctattcacactgaccttgcacttactgtaagacaaccaattggcccagttcttgctatttctccttggaatgcacctgttgtattagcaagtagagccatcttggctccattggctgctggttgttctgttatcttgaaggcttccgagaaggctccagaatctgcctacctcatagtcagaaccttcattgatgcaggagtaccacctaaggcattgcaattagtatttatcaagcccgaggacaacgctaccttcattagctcgattttgcacactggttcaatcagaaagatcaacttcactggatcaactctcgttgggaagaaaattgcagaagttgccagtaagtacttagtgccatatcttatggaattaggagggaagaacgtctctattgttgaaaaggatgctgacttaaccaaggcagctggtagtattatctggagctcgtggtcccacaaaggtcaaatatgtatgagcacagacaaggtttttgttgaagattctatatacgaccactttattgcccaattaaaagagctggctgcggatatcgtgaaagaccctgactaccaaatatctcaaagagatattacattcaaaagaaagcttgttgagttggtaaaggatgccctagacaagggtgctaacttggtgtttggtgaactcaattctgatgtcaacagcagctcattcagtccattgatattagagaatgtcacttcagacatgttgcttgattccactgaatccttcggacctttgttttctgtgcataagtatgccaatacgaacaaactagtcaaggaattaaacagagttgactatgggttgaaggcttctatttggtcccataatgttttggaagccttagaaaccgcaaagaagatccatgtcggtggtgtacatatcaatagtccaactatccatgatgaaccaactcttccacacggtggtgttaaatcaagtggaactggaagattcaactcgacatggggaattgatgacttttctatcacaaaaactattaccctaagccagtga

SEQ ID NO: 755 - protein, 477 aa, Artificial Sequence
  ALD4 from Pichia stipitis
MATASTTFSSIIEGKVFYTEGKHPVYSHDNHEEIIHHFSYLTDIKKSVPQIAAAAEQGFEEWSSFAYAEKVKIFDKAAILLTERRDELIASHKNIGGPTWFSHVNADESVSQLKEYTGLLSRPTGVVAQSIHTDLALTVRQPIGPVLAISPWNAPVVLASRAILAPLAAGCSVILKASEKAPESAYLIVRTFIDAGVPPKALQLVFIKPEDNATFISSILHTGSIRKINFTGSTLVGKKIAEVASKYLVPYLMELGGKNVSIVEKDADLTKAAGSIIWSSWSHKGQICMSTDKVFVEDSIYDHFIAQLKESAADIVKDPDYQISQRDITFKRKLVELVKDALDKGANLVFGELNSDVNSSSFSPLILENVTSDMLLDSTESFGPLFSVHKYANTNKLVKELNRVDYGLKASIWSHNVLEALETAKKIHVGGVHINSPTIHDEPTLPHGGVKSSGTGRFNSTWGIDDFSITKTITLSQ

SEQ ID NO: 756 - DNA, 1488 bp, Artificial Sequence
  ALD5 from Pichia stipitis
atgtccttgccattgttcgttcccatcaaattgccaaacggcactacctatgagcagcctaccggtttgttcatcaacaacgagtttgtccagtccaagtccaagaagacctttggaactgtttctccttctactgaagaagagatcacccaagtctacgaagccttctccgaagatatcgatgatgccgttgaagctgctactgctgctttccactcatcgtggtctacttccgaccctcaagtcagaatgaaggttctctacaaattggctgacttgatcgacgaacacgccgacactttggcccacattgaagctcttgataacggtaagtcgttgatgtgttccaagggtgacgttgctttgactgccgcctacttcagatcctgtgctggctggaccgacaagattaagggttctgttatcgaaactggtgacacccactttaactacaccagaagagaaccaattggtgtttgtggccagatcatcccatggaacttcccattgttgatggcttcctggaagttaggaccagtcctttgtaccggttgcaccactgttttgaagactgctgaatcgactcctttgtctgctctttacttggcttctttgatcaaggaagccggtgctccacctggtgttgtcaatgttgtttccggtttcggtccaactgccggtgctccaatctcttctcacccaaagatcaagaaggttgccttcactggttctaccgctaccggtagacacatcatgaaggctgctgctgaatccaacttgaagaaggtcactttggaattgggtggtaagtctccaaacattgtctttgacgatgctgacgttaagtccaccatccaacacttggttactggtatcttctacaacactggtgaagtgtgctgtgccggttccagaatctacgtccaggaaggtatctacgacaagattgtttccgagttcaagaatgcagccgaatcacttaagatcggtgacccattcaaggaagacaccttcatgggtgcccaaacctctcaattgcaattggacaagatcttgaagtacatcgatatcggtaagaaggaaggtgccaccgttatcactggtggtgaaagattcggtaacaagggttactttatcaagccaaccatcttcggagatgtcaaggaagaccaccagatcgtcagggatgaaatcttcggtcctgttgtcaccatcaccaagttcaagaccgtcgaagaagtcatcgccttggccaacgactccgagtacggtttggctgctggtgttcacaccactaacctcagcactgccatcagtgtttccaacaagatcaattccggtaccatttgggtcaacacctacaatgacttccacccaatggttccattcggaggttactcccaatctggtattggtagagaaatgggagaagaagccttggacaactacacccaggtcaaggcagtcagaattggtcttagccagtaa

SEQ ID NO: 757 - protein, 495 aa, Artificial Sequence
  ALD5 from Pichia stipitis
MSLPLFVPIKLPNGTTYEQPTGLFINNEFVQSKSKKTFGTVSPSTEEEITQVYEAFSEDIDDAVEAATAAFHSSWSTSDPQVRMKVLYKLADLIDEHADTLAHIEALDNGKSLMCSKGDVALTAAYFRSCAGWTDKIKGSVIETGDTHFNYTRREPIGVCGQIIPWNFPLLMASWKLGPVLCTGCTTVLKTAESTPLSALYLASLIKEAGAPPGVVNVVSGFGPTAGAPISSHPKIKKVAFTGSTATGRHIMKAAAESNLKKVTLELGGKSPNIVFDDADVKSTIQHLVTGIFYNTGEVCCAGSRIYVQEGIYDKIVSEFKNAAESLKIGDPFKEDTFMGAQTSQLQLDKILKYIDIGKKEGATVITGGERFGNKGYFIKPTIFGDVKEDHQIVRDEIFGPVVTITKFKTVEEVIALANDSEYGLAAGVHTTNLSTAISVSNKINSGTIWVNTYNDFHPMVPFGGYSQSGIGREMGEEALDNYTQVKAVRIGLSQ

SEQ ID NO: 758 - DNA, 1680 bp, Artificial Sequence
  ALD7 from Pichia stipitis
atgactcctccttcagcaaacaccctcaaggactccgtttcgtccgtcgaatcgttcacaaagatcgacaaggccaccccctcggcttccaccaaggcttctgagtccatcttgaagtacactgctttggacgacattcctgttggagtcaagaagcttactgactcgttccacaagaatggaaagactcactccatccagtacagattgaaccagttgagaaacctctattttgtcatcaaggataaccaggatgccatctgcgatgccctcttcaaggatttcggcagagtgcctactgagtcgcagatcttggaaatcgatggaagcttgaacgagttggtgcacaccatggccaacttgcacaactggttgaaacccgaacctgtcaaggacttgcccattacattgaagctgaatcctatctacattgaaagaattccctacggagttgtgttgatcatctctcccttcaactacccattcttcctctcattttcagccatcattggggccattgctgctggtaacgtggttgtgttcaagccctccgaattgaccccacacttttcgcagttgttcactaacttgttgtctgaggctcttgatgatgaccttttgttcaccataaacggttcgattcccgagaccacgaaggccttggaacagaagtacgacaagatcatgtacaccggtaataacgctgtaggaaccattatcgccaagaaggctgccgagactttaactcctgtcatcttagagttgggaggaaagtcaccagcgtttgtcttggacgatctttctgaaaaggagttgaccgtcgtagccagaagaatcgcatggggtagatttaccaatgctggtcaaacctgtgtggccgtggactatgttttggctcatgactctatcaaagagagattggttcgcgagatcgtcaaggtggtcaaggaggagttctatccagaacttaacaaagacaacaaggacttcacccacattatccacgaccgtgctgtatccaacttatccaagatcatcaagaccaccaagggtaagattgttgttggaggtgatgtagacgaagcctcgaggtacgtggctccaactgtcgtggacaatgtagactgggacgactctaccatgaagggcgagatctttggtcctatcttgcctatcttgtcgtacagctctttggatgaagctttgtcaagattgcagagtcgtcatgacactcctttggcacagtatatcttcactggtggatcgacttcccgtgctaagaaccctaaacttaacaagatctcacagcagatcagatccggtggtgctgtcattaacgatgtcttgatgcacgtagccttaactaatgccccattcggaggtattggtagttccggttcgggatcgtaccatggttggttttctttccgtgcatttactcatgagagaaccaccatggaacaaaagttgtggaacgactttgttttgaaggctagataccctcctttcacagaaaagaaccagaagttggtcagtgcttcacagacagactacaacggtaaggtctggtttgatagacaaggggacgtcagagtcaagggtccatcgggcttgttcagcacttggacttctgttgctggtgtcgcagccttgatctactactttgttggtaatttgtag

SEQ ID NO: 759 - protein, 559 aa, Artificial Sequence
  ALD7 from Pichia stipitis
MTPPSANTLKDSVSSVESFTKIDKATPSASTKASESILKYTALDDIPVGVKKLTDSFHKNGKTHSIQYRLNQLRNLYFVIKDNQDAICDALFKDFGRVPTESQILEIDGSLNELVHTMANLHNWLKPEPVKDLPITLKSNPIYIERIPYGVVLIISPFNYPFFLSFSAIIGAIAAGNVVVFKPSELTPHFSQLFTNLLSEALDDDLLFTINGSIPETTKALEQKYDKIMYTGNNAVGTIIAKKAAETLTPVILELGGKSPAFVLDDLSEKELTVVARRIAWGRFTNAGQTCVAVDYVLAHDSIKERLVREIVKVVKEEFYPELNKDNKDFTHIIHDRAVSNLSKIIKTTKGKIVVGGDVDEASRYVAPTVVDNVDWDDSTMKGEIFGPILPILSYSSLDEALSRLQSRHDTPLAQYIFTGGSTSRAKNPKLNKISQQIRSGGAVINDVLMHVALTNAPFGGIGSSGSGSYHGWFSFRAFTHERTTMEQKLWNDFVLKARYPPFTEKNQKLVSASQTDYNGKVWFDRQGDVRVKGPSGLFSTWTSVAGVAALIYYFVGNL

SEQ ID NO: 760 - DNA, 1440 bp, Artificial Sequence
  aldA from E. coli
atgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaa

SEQ ID NO: 761 - protein, 479 aa, Artificial Sequence
  aldA from E. coli
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 762 - DNA, 1539 bp, Artificial Sequence
  aldB from E. coli
atgaccaataatcccccttcagcacagattaagcccggcgagtatggtttccccctcaagttaaaagcccgctatgacaactttattggcggcgaatgggtagcccctgccgacggcgagtattaccagaatctgacgccggtgaccgggcagctgctgtgcgaagtggcgtcttcgggcaaacgagacatcgatctggcgctggatgctgcgcacaaagtgaaagataaatgggcgcacacctcggtgcaggatcgtgcggcgattctgtttaagattgccgatcgaatggaacaaaacctcgagctgttagcgacagctgaaacctgggataacggcaaacccattcgcgaaaccagtgctgcggatgtaccgctggcgattgaccatttccgctatttcgcctcgtgtattcgggcgcaggaaggtgggatcagtgaagttgatagcgaaaccgtggcctatcatttccatgaaccgttaggcgtggtggggcagattatcccgtggaacttcccgctgctgatggcgagctggaaaatggctcccgcgctggcggcgggcaactgtgtggtgctgaaacccgcacgtcttaccccgctttctgtactgctgctaatggaaattgtcggtgatttactgccgccgggcgtggtgaacgtggtcaatggcgcaggtggggtaattggcgaatatctggcgacctcgaaacgcatcgccaaagtggcgtttaccggctcaacggaagtgggccaacaaattatgcaatacgcaacgcaaaacattattccggtgacgctggagttgggcggtaagtcgccaaatatcttctttgctgatgtgatggatgaagaagatgcctttttcgataaagcgctggaaggctttgcactgtttgcctttaaccagggcgaagtttgcacctgtccgagtcgtgctttagtgcaggaatctatctacgaacgctttatggaacgcgccatccgccgtgtcgaaagcattcgtagcggtaacccgctcgacagcgtgacgcaaatgggcgcgcaggtttctcacgggcaactggaaaccatcctcaactacattgatatcggtaaaaaagagggcgctgacgtgctcacaggcgggcggcgcaagctgctggaaggtgaactgaaagacggctactacctcgaaccgacgattctgtttggtcagaacaatatgcgggtgttccaggaggagatttttggcccggtgctggcggtgaccaccttcaaaacgatggaagaagcgctggagctggcgaacgatacgcaatatggcctgggcgcgggcgtctggagccgcaacggtaatctggcctataagatggggcgcggcatacaggctgggcgcgtgtggaccaactgttatcacgcttacccggcacatgcggcgtttggtggctacaaacaatcaggtatcggtcgcgaaacccacaagatgatgctggagcattaccagcaaaccaagtgcctgctggtgagctactcggataaaccgttggggctgttctga

SEQ ID NO: 763 - protein, 512 aa, Artificial Sequence
  aldB from E. coli
MTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 764 - DNA, 1488 bp, Artificial Sequence
  aldH(puuC) from E. coli
atgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctga

SEQ ID NO: 765 - protein, 495 aa, Artificial Sequence
  aldH(puuC) from E. coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 766 - DNA, 725 bp, Artificial Sequence
  UAS (PKG1)-FAB1
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 767 - DNA, 47 bp, Artificial Sequence
  T-FBA1(SalI) primer
attctacgtacgtcgacgcctacttggcttcacatacgttgcatacg

SEQ ID NO: 768 - DNA, 49 bp, Artificial Sequence
  B-FBA1(SpeI) primer
gtatcaaatactagtttgaatatgtattacttggttatggttatatatg

SEQ ID NO: 769 - DNA, 10494 bp, Artificial Sequence
  pWS358-PGK1p-GUS plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaactagtatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatactccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 770 - DNA, 43 bp, Artificial Sequence
  T-U/PGK1(KpnI) primer
actacagatggtaccaattaccgtcgctcgtgatttgtttgca

SEQ ID NO: 771 - DNA, 45 bp, Artificial Sequence
  B-U/PGK1(SalI) primer
agcatccttgtcgacaggaccttgttgtgtgacgaaattggaagc

SEQ ID NO: 772 - DNA, 7533 bp, Artificial Sequence
  pYZ067DkivDDilvD plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccgggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 773 - DNA, 12518 bp, Artificial Sequence
  pK9G9.OLE1p.ilvD plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcgaaggagtggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgctttgttgtaatgttttagtgctgtttataatatgatcaccacaactatctattactatgatgttctattctacgtaatacaaaatataaacggaaacagaagtaggaaagatggaaatagaacaataaatgaatcaagatctgcccccatatatatatgtatatgctgatttgcaagactcgatgagccaggagccgatgatttgctgcatatattgttaactactattatttccacctttgtgtgccatccccatagccgtaacaatagggataggtgtgtctgagtgagcaagactcgtagaagcacacctggttgggcactagataaggtttgttgagtgttcaacgtccgaaagaaagctgccgactatgcgaagagaaccttaagccgttattacctctgcctgtcacaggcgatgtgatgctaacgaacagcaccagagccaagccaactggggcggtctgcagagaaggctgggatacccgaaatagctcgctcaacagctttttttcttctacggaagcccaccagataagcgcctttgttgggcccgctaaccccgggacatgcccgggctcggagttagtttttgcacggccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 774 - DNA, 1029 bp, Artificial Sequence; identical to SEQ ID NO: 34
  Anaerostipes caccae KARI-AB1G9 variant

SEQ ID NO: 775 - DNA, 31 bp, Artificial Sequence; identical to SEQ ID NO: 264
  Primer pOLE1-NgoMI

SEQ ID NO: 776 - DNA, 34 bp, Artificial Sequence; identical to SEQ ID NO: 265
  Primer pOLE1-PmlI

SEQ ID NO: 777 - DNA, 1029 bp, Artificial Sequence; identical to SEQ ID NO: 34
  K9G9 ilvC gene

SEQ ID NO: 778 - DNA, 9613 bp, Artificial Sequence
  pLH701 plasmid containing K9G9 variant
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcgaaggagtggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggc

SEQ ID NO: 779 - DNA, 28 bp, Artificial Sequence
  N1090 primer
aatcccgatgtatgggtttggttgccag

SEQ ID NO: 780 - DNA, 7589 bp, Artificial Sequence; identical to SEQ ID NO: 369
  Als integration plasmid

SEQ ID NO: 781 - protein, 338 aa, Artificial Sequence
  k9_Jarvis_SH
MAKIYYQEDCNLSLLDGKTIAVIGYGSQGHAHALNAKESGCNVIIGLFEGAEEWKRAEEQGIEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 782 - protein, 338 aa, Artificial Sequence
  K9_Kelly
MAKIYYQEDCNLSLLDGKTIAVIGYGSQGHAHALNAKESGCNVIIGLFEGGEEWNRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 783 - protein, 338 aa, Artificial Sequence
  K9_Norman_SH
MAKIYYQEDCNLSLLDGKTIAVIGYGSQGHAHALNAKESGCNVIIGLFECAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 784 - DNA, 24 bp, Artificial Sequence
  N1237 primer
gatgatgctatttggtgcagaggg

SEQ ID NO: 785 - DNA, 27 bp, Artificial Sequence
  N1238 primer
ccttactgaagtatttagttatcatgg

SEQ ID NO: 786 - DNA, 24 bp, Artificial Sequence
  Primer N1240
ggatgtatgggctaaatgtacggg

SEQ ID NO: 787 - DNA, 24 bp, Artificial Sequence
  N1241 Primer
catccagtgtcgaaaacgagctcg

SEQ ID NO: 788 - protein, 343 aa, Artificial Sequence; identical to SEQ ID NO: 33
  Anaerostipes caccae KARI- K9D3 variant

SEQ ID NO: 789 - DNA, 448 bp, Artificial Sequence
  Saccharomyces cerevisiae CUP1 promoter
cccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatc

SEQ ID NO: 790 - DNA, 1713 bp, Artificial Sequence
  Bacillus subtilis AlsS
ttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 791 - protein, 571 aa, Artificial Sequence
  Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 792 - DNA, 250 bp, Artificial Sequence
  Saccharomyces cerevisiae CYC1 terminator 2
ccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatga

SEQ ID NO: 793 - DNA, 1181 bp, Artificial Sequence
  Saccharomyces cerevisiae ILV5 promoter
taaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactagt

SEQ ID NO: 794 - DNA, 759 bp, Artificial Sequence
  Saccharomyces cerevisiae ILV5 terminator
ggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagtatataatttttcaggtaaaatttagtacgatagtaaaatacttctcgaactcgtcacatatacgtgtacataatgtctgaaccagctcaaaagaaacaaaaggttgctaacaactctctaga

SEQ ID NO: 795 - DNA, 643 bp, Artificial Sequence
  Saccharomyces cerevisiae FBA1 promoter
gaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctaga

SEQ ID NO: 796 - DNA, 1188 bp, Artificial Sequence
  Saccharomyces cerevisiae KARI ILV5
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 797 - protein, 395 aa, Artificial Sequence
  Saccharomyces cerevisiae KARI coding region
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 798 - DNA, 244 bp, Artificial Sequence
  Saccharomyces cerevisiae CYC1 terminator
attaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatga

SEQ ID NO: 799 - DNA, 1017 bp, Artificial Sequence
  Pf5.IlvC-JEA1 variant
atgaaagttttctacgataaagactgcgacctgtcgatcatccaaggtaagaaagttgccatcatcggcttcggttcccagggccacgctcaagcactcaacctgaaggattccggcgtagacgtgactgttggcctgcctaaaggctttgctgatgtagccaaggctgaagcccacggctttaaagtgaccgacgttgctgcagccgttgccggtgccgacttggtcatgatcctgattccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggaggtattcctgacctgatcgcgatctaccaggacgtttccggcaacgccaagaacgtcgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaactaa

SEQ ID NO: 800 - protein, 338 aa, Artificial Sequence
  Pf5.IlvC-JEA1 variant
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 801 - DNA, 1644 bp, Artificial Sequence
  codon optimized sequence
atgtatacagtaggtgactatctgttggacagattacacgaattaggtatagaagaaatattcggagtaccaggtgactacaatttgcaatttctagatcaaattatttcacacaaagatatgaaatgggtgggaaatgctaatgagttaaatgcctcctatatggccgacgggtacgcaagaacgaaaaaggctgcggcattcttgactacatttggtgttggcgaattatccgcagttaatggcttagcgggctcctatgctgagaacctgcctgttgttgagatcgtgggatctcctacctcgaaagtgcagaacgaaggtaagtttgttcaccatacgttggctgatggtgatttcaagcactttatgaagatgcacgaaccggttactgctgccaggactttattgacagccgagaatgcaactgttgaaattgatagagtgttgtctgccttactaaaggaaagaaagccggtttacatcaatttacctgtagatgtagctgccgctaaggctgaaaaaccatccttgcctcttaagaaggaaaattccacgtcgaatacatctgatcaagagattctgaacaaaatacaggaaagtctgaagaatgccaagaaaccaattgtaatcacaggccatgaaattatatcgttcggcctagagaagactgttactcagtttatttcaaagactaagttacctattactactttgaactttggtaaatcatctgttgatgaagcattgccctcatttttggggatttacaacggtactctgtcagagccaaacttgaaggaatttgtggaatctgctgattttattcttatgttgggtgtaaagcttaccgattctagtacgggtgcatttactcaccatcttaatgaaaataaaatgatttccttgaatatcgatgaaggtaaaattttcaacgaaagaatccaaaatttcgacttcgaatccctgatatcatctcttcttgacttgtccgaaattgaatataaaggcaagtacatagataaaaagcaagaagattttgtaccttctaacgcgctgttgtcacaagatagactgtggcaagctgtcgaaaatttgacccaaagtaatgagacgatcgtggctgaacaaggcacttctttcttcggtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagc

SEQ ID NO: 802 - DNA, 1125 bp, Artificial Sequence
  codon optimized sequence
atgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttt

SEQ ID NO: 803 - protein, 375 aa, Artificial Sequence
  Equus caballus
MSTAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 804 - protein, 548 aa, Artificial Sequence
  Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 805 - DNA, 1023 bp, Artificial Sequence
  Saccharomyces cerevisiae TDH3 promoter
caccgcggtggggcgcgccctattttcgaggaccttgtcaccttgagcccaagagagccaagatttaaattttcctatgacttgatgcaaattcccaaagctaataacatgcaagacacgtacggtcaagaagacatatttgacctcttaacaggttcagacgcgactgcctcatcagtaagacccgttgaaaagaacttacctgaaaaaaacgaatatatactagcgttgaatgttagcgtcaacaacaagaagtttaatgacgcggaggccaaggcaaaaagattccttgattacgtaagggagttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaactagtaaacaaa

SEQ ID NO: 806 - DNA, 21 bp, Artificial Sequence
  Primer OT1068
caaaagctgagctccaccgcg

SEQ ID NO: 807 - DNA, 44 bp, Artificial Sequence
  Primer OT1067
gtttactagtttatgtgtgtttattcgaaactaagttcttggtg

SEQ ID NO: 808 - DNA, 9333 bp, Artificial Sequence
  pLH467
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 809 - DNA, 8994 bp, Artificial Sequence
  Synthetic construct pRS425::GPM-sadB
ctagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggta

SEQ ID NO: 810 - DNA, 753 bp, Artificial Sequence
  Saccharomyces cerevisiae GPM1 promoter
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 811 - DNA, 1047 bp, Artificial Sequence
  Achromobacter xylosoxidans sadB
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 812 - protein, 348 aa, Artificial Sequence
  Achromobacter xylosoxidans sadB
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 813 - DNA, 39 bp, Artificial Sequence
  Primer OT1074
cacacatattacaatagctagctgaggatgaaagctctg

SEQ ID NO: 814 - DNA, 39 bp, Artificial Sequence
  Primer OT1075
cagagctttcatcctcagctagctattgtaatatgtgtg

SEQ ID NO: 815 - DNA, 9075 bp, Artificial Sequence
  pLH435
ctagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggta

SEQ ID NO: 816 - DNA, 11367 bp, Artificial Sequence
  pLH441
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatagccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatgagtgtgcgtaatgagttgtaaaattatgtataaacctactttctctcacaagttatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 817 - DNA, 9491 bp, Artificial Sequence
  Synthetic construct pRS423 FBA ilvD(Strep)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 818 - DNA, 1000 bp, Artificial Sequence
  FBA1 terminator nt 4861 to 5860
gttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaa

SEQ ID NO: 819 - DNA, 1713 bp, Artificial Sequence
  Streptococcus mutans ilvD coding region
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaa

SEQ ID NO: 820 - protein, 571 aa, Artificial Sequence
  Streptococcus mutans ilvD
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 821 - DNA, 2145 bp, Artificial Sequence
  GPM-sadB-ADHt segment
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 822 - DNA, 4280 bp, Artificial Sequence
  pUC19-URA3r
ggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccccggctctgagacagtagtaggttagtcatcgctctaccgacgcgcaggaaaagaaagaagcattgcggattacgtattctaatgttcagcccgcggaacgccagcaaatcaccacccatgcgcatgatactgagtcttgtacacgctgggcttccagtgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcttcagcccgcggaacgccagcaaatcaccacccatgcgcatgatactgagtcttgtacacgctgggcttccagtgatgatacaacgagttagccaaggtgagcacggatgtctaaattagaattacgttttaatatctttttttccatatctagggctag

SEQ ID NO: 823 - DNA, 30 bp, Artificial Sequence
  Primer 114117-11A
gcatgcttgcatttagtcgtgcaatgtatg

SEQ ID NO: 824 - DNA, 54 bp, Artificial Sequence
  Primer 114117-11B
gaacattagaatacgtaatccgcaatgcactagtaccacaggtgttgtcctctg

SEQ ID NO: 825 - DNA, 54 bp, Artificial Sequence
  Primer 114117-11C
cagaggacaacacctgtggtactagtgcattgcggattacgtattctaatgttc

SEQ ID NO: 826 - DNA, 28 bp, Artificial Sequence
  Primer 114117-11D
caccttggctaactcgttgtatcatcac

SEQ ID NO: 827 - DNA, 100 bp, Artificial Sequence
  Primer 114117-13A
ttttaagccgaatgagtgacagaaaaagcccacaacttatcaagtgatattgaacaaagggcgaaacttcgcatgcttgcatttagtcgtgcaatgtatg

SEQ ID NO: 828 - DNA, 98 bp, Artificial Sequence
  Primer 114117-13B
cccaattggtaaatattcaacaagagacgcgcagtacgtaacatgcgaattgcgtaattcacggcgataacaccttggctaactcgttgtatcatcac

SEQ ID NO: 829 - DNA, 29 bp, Artificial Sequence
  Primer 112590-34G
caaaagcccatgtcccacaccaaaggatg

SEQ ID NO: 830 - DNA, 26 bp, Artificial Sequence
  Primer 112590-34H
caccatcgcgcgtgcatcactgcatg

SEQ ID NO: 831 - DNA, 28 bp, Artificial Sequence
  Primer 112590-34F
tcggtttttgcaatatgacctgtgggcc

SEQ ID NO: 832 - DNA, 22 bp, Artificial Sequence
  Primer 112590-49E
gagaagatgcggccagcaaaac

SEQ ID NO: 833 - DNA, 2745 bp, Artificial Sequence
  pdc1:: PPDC1-ilvD-FBA1t-URA3r
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaa

SEQ ID NO: 834 - DNA, 27 bp, Artificial Sequence
  Primer 114117-36D
gacttttggaagcctgaagaaactggc

SEQ ID NO: 835 - protein, 338 aa, Artificial Sequence
  K9_Ophelia_SH
MAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIASKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 836 - DNA, 26 bp, Artificial Sequence
  112590-30F
ccaggccaattcaacagactgtcggc

SEQ ID NO: 837 - DNA, 2347 bp, Artificial Sequence
  URA3r2 template DNA
gcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtg

SEQ ID NO: 838 - DNA, 80 bp, Artificial Sequence
  Primer 114117-45A
cttcgaagaatatactaaaaaatgagcaggcaagataaacgaaggcaaaggcattgcggattacgtattctaatgttcag

SEQ ID NO: 839 - DNA, 81 bp, Artificial Sequence
  Primer 114117-45B
tatacacatgtatatatatcgtatgctgcagctttaaataatcggtgtcacaccttggctaactcgttgtatcatcactgg

SEQ ID NO: 840 - DNA, 90 bp, Artificial Sequence
  Primer 384
atggttcatttaggtccaaaaaaaccacaagccagaaagggttccatggccgatgtgccagcattgcggattacgtattctaatgttcag

SEQ ID NO: 841 - DNA, 91 bp, Artificial Sequence
  Primer 385
ttaagcaccgatgataccaacggacttaccttcagcaattcttttttgggccaaagcagccaccttggctaactcgttgtatcatcactgg

SEQ ID NO: 842 - DNA, 24 bp, Artificial Sequence
  Primer N869
ctaggatgagtagcagcacgttcc

SEQ ID NO: 843 - DNA, 26 bp, Artificial Sequence
  Primer N871
ccaattccgtgatgtctctttgttgc

SEQ ID NO: 844 - DNA, 20 bp, Artificial Sequence
  Primer N946
gtgaacgagttcacaaccgc

SEQ ID NO: 845 - DNA, 22 bp, Artificial Sequence
  Primer N947
gttcgttccagaattatcacgc

SEQ ID NO: 846 - DNA, 26 bp, Artificial Sequence
  Primer PDC5:KanMXF
gacttgaataatgcagcggcgcttgc

SEQ ID NO: 847 - DNA, 30 bp, Artificial Sequence
  Primer PDC5::KanMXR
ccaccctcttcaattagctaagatcatagc

SEQ ID NO: 848 - DNA, 90 bp, Artificial Sequence
  Primer T001
atgcctaccttgtatactgatatcgaaatcccacaattgaaaatctctttaaagcaaccggcattgcggattacgtattctaatgttcag

SEQ ID NO: 849 - DNA, 97 bp, Artificial Sequence
  T002 primer
ttagttgtccaaagagagatttatgtgaactgcttttgtttgaagataggtatcaacaccactttgcaccttggctaactcgttgtatcatcactgg

SEQ ID NO: 850 - DNA, 29 bp, Artificial Sequence
  T003 primer
gaacgttacagaaaagcaggctgggaagc

SEQ ID NO: 851 - DNA, 25 bp, Artificial Sequence
  T004 primer
gacctagtaacaacaattgttccgc

SEQ ID NO: 852 - DNA, 27 bp, Artificial Sequence
  T005 primer
ccgtgctacctcttaatgtgtcacaag

SEQ ID NO: 853 - protein, 338 aa, Artificial Sequence
  K9_Pat_SH
MAKIYYQEDCNLSLLDGKTIAVIGYGSQGHAHALNAKESGCNVIIGLLEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 854 - protein, 338 aa, Artificial Sequence
  K9_Quetnin_SH
MAKIYYQEDCNLSLLDGKTIAVIGYGSQGHAHALNAKESGCNVIIGLFEGAEEWKRAEEQGFEVYTAAEAAKKADIIMILIPDEKQATIYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 855 - protein, 338 aa, Artificial Sequence
  K9_Ralph_SH
MAKIYYQEDCNLSLLDGKTIAVIGYGSQGHAHALNAKESGCNVIIGLFEGAEEWKRAEEQGLEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 856 - protein, 338 aa, Artificial Sequence
  K9_Ursala_SH
MAKIYYQEDCNLSLLDGKTIAVIGYGSQGHAHALNAKESGCNVIIGLFEGVEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 857 - protein, 338 aa, Artificial Sequence
  K9_Watson_SH
MAKIYYQEDCNLSLLDGKTIAVIGYGSQGHAHALNAKESGCNVIIGLFEGAEECKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 858 - DNA, 1017 bp, Artificial Sequence
  K9_Watson_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtgcaaaagagctgaagaacaaggcttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 859 - protein, 338 aa, Artificial Sequence
  K9_Xavier_SH
MAKIYYQEDCNLSLLDGKTIAVIGYGSQGHAHALNAKESGCNVIIGLFEGAEEWKRAEEQGFEVYTAAEAAKKADIIMILIPDEKQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 860 - DNA, 1017 bp, Artificial Sequence
  k9_Zeke_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaatgcaggctgccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 861 - protein, 338 aa, Artificial Sequence
  K9_Zeke_SH
MAKIYYQEDCNLSLLDGKTIAVIGYGSQGHAHALNAKESGCNVIIGLFEGAEEWKRAEEQGFEVYTAAEAAKKADIIMILIPDEMQAAMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 862 - DNA, 1017 bp, Artificial Sequence
  K9_Annabel_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaatgcaggctatcatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 863 - protein, 338 aa, Artificial Sequence; identical to SEQ ID NO: 861
  K9_Annabel_SH

SEQ ID NO: 864 - protein, 340 aa, Artificial Sequence; identical to SEQ ID NO: 133
  Lactococcus lactis KARI encoded

SEQ ID NO: 865 - DNA, 1074 bp, Artificial sequence
  AOX1 from Pichia stipitis
atgctttctgtgcagactacaagagccgccaagttgcaactaggtcaattacctctgattgcctacaccgccagaagtggaagacttcaccaccaattctactccaccgttgctgaaaagacagccaaccctacgccaaacacctcagataaaactaatatttttgatattagaaccaaggtgtacgatgagactgatataagaaaacatgacgacaatcagtttatcacccatcctttatttcctcatcctacgttttcgcaggaagattgtttgaaagttggttacgaacatcgtcctcctcggacttttggtgacaaaatggctttcagaggcattgaacttgtcagaggttctttcgactttgtcaccggttacaagaagccaaagacacaggctgatatcgattcaggttttaaaggtaccagatacgagatgacagaaggtaaatggttgaccagatgtatattcttagaaagtattgctggagttccaggtgccgttgcttccttcatcagacacttgcattctttacgtttgttgaagagagacaaagcctggatcgaaaccttacttgatgaagcattcaacgaaagaatgcatttacttaccttcatcaagattggcaaacctagttggttcaccagaacaatcatctacgtcggccaaggtgtattctgcaacttgttcttcttgttctacttggccaaccctaagtattgtcacaggtttgttggctaccttgaagaagaggctgttagtacctacactcatttcgttcatgaattacaatcaggtaagcttcccaagtttgagaacatcaagattccaaccattgcatggcaatactggccagagttgaccgagaattcgtccatgttggacttgattttaagaatcagagccgacgaagccaagcacagagaagtcaaccacaccttggccaatttagatcaaagaaaggacagaaatccatttgggttggcaattccggatctcaaggaaccgcaacccgaaagtggcttaaaggttacgaaaccccacggctgggagaaggaagaattgaaattgtaa

SEQ ID NO: 866 - protein, 357 aa, Artificial Sequence
  AOX1 from Pichia stipitis
MLSVQTTRAAKLQLGQLPSIAYTARSGRLHHQFYSTVAEKTANPTPNTSDKTNIFDIRTKVYDETDIRKHDDNQFITHPLFPHPTFSQEDCLKVGYEHRPPRTFGDKMAFRGIELVRGSFDFVTGYKKPKTQADIDSGFKGTRYEMTEGKWLTRCIFLESIAGVPGAVASFIRHLHSLRLLKRDKAWIETLLDEAFNERMHLLTFIKIGKPSWFTRTIIYVGQGVFCNLFFLFYLANPKYCHRFVGYLEEEAVSTYTHFVHELQSGKLPKFENIKIPTIAWQYWPELTENSSMLDLILRIRADEAKHREVNHTLANLDQRKDRNPFGLAIPDLKEPQPESGLKVTKPHGWEKEELKL

SEQ ID NO: 867 - DNA, 1992 bp, Artificial Sequence
  AOX2 from Pichia stipitis
atggccattcctgaagaattcgatattcttgtcctgggtggtggatccagtggatcctgtattgccggaagattggccaacttggaccactccttgaaagttggtcttatcgaggctggtgagaacaatcttaacaacccatgggtctaccttccaggtatttacccaagaaacatgaagttggactccaaaactgcttctttctacacctccaacccttctcctcatttgaatggtagaagagctattgtcccatgtgccaacatcttgggtggtggttcttcgatcaacttcatgatgtacaccagaggttccgcttctgattacgatgactttgaagctgagggatggaagaccaaggatttgcttcctttgatgaagaagactgagacttaccaaagagcttgcaacaaccctgaaattcacggttttgaaggtccaatcaaggtttctttcggtaactacacttacccagtttgtcaagacttcttgagagcaactgaatcccaaggtattccatacgttgacgacttggaagacttggtgactgctcatggtgctgaacactggctgaaatggatcaacagagacactggtcgtcgttccgactctgctcatgccttcgttcattctacgatgagaaaccacgacaatctgtacttgatctgcaacaccaaagttgacaagattattgttgaagacggaagagctgctgctgtcagaaccgttccaagtaaacctttgaacgcaaagaagccaactcacaaggtttatcgtgctagaacgcaaatcgttttgtcttgtggtaccatctcttctcctctggttctgcaaagatccggttttggtgacccaatcaaattgagagccgctggtgttaagcctttggtcaacttgccaggtgttggaagaaacttccaagaccactactgcttcttctctccttacagaattaagccccaatacgagtctttcgatgacttcgtacgtggtgacgctaacattcaaaagaaggtattcgaccaatggtacgctaacggtactggtccattggccaccaacggtattgaagccggtgtcaagattagaccaactccagaagaattatctcagatggacgagtccttccaagagggttacagagagtacttcgaagacaaaccagacaagccagttatgcactattccatcattgctggtttcttcggtgaccacaccaagattccacctggaaagtacatgaccatgttccacttcttggagtacccattctccagaggttctatccacatcacctctccagacccatacgcaactccagactttgacccaggtttcatgaacgatgaaagagacatggctcctatggtctggtcttacaagaagtccagagagactgccagaaaaatggaccactttgctggtgaggttacttcccaccaccctctgttcccatactcatccgaggccagagcttacgagatggatttggagacctccaacgcctacggtggaccactgaacttgactgctggtcttgctcacggttcttggactcagcctttgaagaagcctgctggaagaaacgaaggacatgttacttccaaccaagtcgagcttcatccagacattgagtacgatgaggaggatgataaggccattgagaactacattcgtgagcacactgagaccacatggcactgtctgggaacctgttccattggtccaagagagggttccaagatcgtcaaatggggtggtgttttggatcacagatctaacgtttacggagtcaagggcctgaaggttggtgacttgtccgtctgtccagacaatgttggttgtaacacctacaccaccgctcttttgatcggtgaaaagactgccaccttggttggtgaagacttaggatacacaggtgaggccttagacatgactgtacctcagttcaagttgggcacttacgagaagactggtcttgctagattctag

SEQ ID NO: 868 - protein, 663 aa, Artificial Sequence
  AOX2 from Pichia stipitis
MAIPEEFDILVLGGGSSGSCIAGRLANLDHSLKVGLIEAGENNLNNPWVYLPGIYPRNMKLDSKTASFYTSNPSPHLNGRRAIVPCANILGGGSSINFMMYTRGSASDYDDFEAEGWKTKDLLPLMKKTETYQRACNNPEIHGFEGPIKVSFGNYTYPVCQDFLRATESQGIPYVDDLEDLVTAHGAEHWLKWINRDTGRRSDSAHAFVHSTMRNHDNLYLICNTKVDKIIVEDGRAAAVRTVPSKPLNAKKPTHKVYRARTQIVLSCGTISSPLVLQRSGFGDPIKLRAAGVKPLVNLPGVGRNFQDHYCFFSPYRIKPQYESFDDFVRGDANIQKKVFDQWYANGTGPLATNGIEAGVKIRPTPEELSQMDESFQEGYREYFEDKPDKPVMHYSIIAGFFGDHTKIPPGKYMTMFHFLEYPFSRGSIHITSPDPYATPDFDPGFMNDERDMAPMVWSYKKSRETARKMDHFAGEVTSHHPLFPYSSEARAYEMDLETSNAYGGPLNLTAGLAHGSWTQPLKKPAGRNEGHVTSNQVELHPDIEYDEEDDKAIENYIREHTETTWHCLGTCSIGPREGSKIVKWGGVLDHRSNVYGVKGLKVGDLSVCPDNVGCNTYTTALLIGEKTATLVGEDLGYTGEALDMTVPQFKLGTYEKTGLARF

SEQ ID NO: 869 - DNA, 1410 bp, Artificial sequence; identical to SEQ ID NO: 690
  YER081W  Chr 5

SEQ ID NO: 870 - protein, 469 aa, Artificial Sequence; identical to SEQ ID NO: 691
  YER081W  Chr 5

SEQ ID NO: 871 - DNA, 1365 bp, Artificial Sequence
  YOR375C  Chr 15
atgtcagagccagaatttcaacaagcttacgaagaagttgtctcctctttggaagactctactcttttcgaacaacacccagaatacagaaaggttttgccaattgtttctgttccagaaagaatcatacaattcagagtcacctgggaaaatgacaagggtgaacaagaagttgctcaaggttacagagtgcaatataactccgccaagggtccatacaagggtggtctacgtttccatccttccgtgaacttgtctatcttgaaattcttgggtttcgaacaaatcttcaagaactccttgaccggcctagacatgggtggtggtaaaggtggtctatgtgtggacttgaagggaagatctaataacgaaatcagaagaatctgttatgctttcatgagagaattgagcagacacattggtcaagacactgacgtgccagctggtgatatcggtgttggtggtcgtgaaattggttacctgttcggtgcttacagatcatacaagaactcctgggaaggtgtcttaaccggtaagggtttgaactggggtggttctttgatcagaccagaagccactggttacggtttagtttactatactcaagctatgatcgactatgccacaaacggtaaggaatctttcgaaggtaagcgcgtcaccatctctggtagtggtaacgttgctcaatacgctgccttgaaggttattgagctaggtggtactgtcgtttccctatctgactccaagggttgtatcatctctgaaactggtatcacctccgaacaagtcgctgatatttccagtgctaaggtcaacttcaagtccttggaacaaatcgtcaacgaatactctactttctccgaaaacaaagtgcaatacattgctggtgctcgtccatggacccacgtccaaaaggtcgacattgctttgccatgtgccacccaaaatgaagtcagcggtgaagaagccaaggccttggttgctcaaggtgtcaagtttattgccgaaggttccaacatgggttccactccagaagctattgccgtctttgaaactgctcgttccaccgccactggaccaagcgaagctgtttggtacggtccaccaaaggctgctaacttgggtggtgttgctgtttctggtttagaaatggcacaaaactctcaaagaatcacatggactagcgaaagagttgaccaagagttgaagagaattatgatcaactgtttcaatgaatgtatcgactatgccaagaagtacactaaggacggtaaggtcttgccatctttggtcaaaggtgctaatatcgcaagtttcatcaaggtctctgatgctatgtttgaccaaggtgatgtattttaa

SEQ ID NO: 872 - protein, 454 aa, Artificial Sequence
  YOR375C  Chr 15   reverse complement
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 873 - protein, 343 aa, Artificial Sequence; identical to SEQ ID NO: 35
  878 C1

SEQ ID NO: 874 - protein, 343 aa, Artificial Sequence
  879 A7
MEECKMAKIYYQEDCNLSLLDGKTIAVIGYGSQGHAHALNAKESGCNVIIGLYEGAKEWKRAEEQGFEVYTAAEAAKKADIIMILINDEMQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 875 - protein, 343 aa, Artificial Sequence
  879 C2
MEECKMAKIYYQEDCNLSLLDGKTIAVIGYGSQGHAQALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 876 - protein, 343 aa, Artificial Sequence
  880 A11
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARTGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHQAEVVGEEIRSLYSWSDEDKLINN

SEQ ID NO: 877 - protein, 343 aa, Artificial Sequence; identical to SEQ ID NO: 417
  880 B4

SEQ ID NO: 878 - protein, 343 aa, Artificial Sequence
  880 D11
MEECKMAKIYYQEDCNLSLLDGKTIAVIGYGSQGHAHALNAKESGCNVIIGLYEGAKEWKRAEEQGFEVYTAAEAAKKADIIMILINDEMQATMYKNDIEPNLEAGNMLMFAHGFNIHFGCIVPPKDVDVTMIAPKGPGHTVRSEYEEGKGVPCLVAVEQDATGKALDMALAYVLAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 879 - protein, 343 aa, Artificial Sequence
  881 A2
MEECKMAKIYYQEDCNLSLLDGKTIAVIGYGSQGHAHALNAKESGCNVIIGLYEGAKEWKRAEEQGFEVYTAAEAAKKADIIMILINDEMQATMYKNDIEPNLEAGNMLMFAHGFNIHFGCIVPPKDVDVTMVAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKTILSDIQDGTFAKDFLVDMSDAGSQVHFKAMRKLASEHPAEVVGEEIRSLYSWSDEDKLINN

SEQ ID NO: 880 - protein, 343 aa, Artificial Sequence; identical to SEQ ID NO: 421
  881 G3

SEQ ID NO: 881 - protein, 343 aa, Artificial Sequence
  881 G9
MEECKMAKIYYQEDCNLSLLDGKTIAVIGYGSQGHAHALNAKESGCNVIIGLYEGAKEWKRAEEQGFEVYTAAEAAKKADIIMILINDEEQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 882 - protein, 343 aa, Artificial Sequence
  882 B12
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIRFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 883 - protein, 343 aa, Artificial Sequence
  882 C10
MEECKMAKIYYQEDCNLSLLDGKTIAVIGYSSQGHAHALNAKESGCNVIIGLYEGAKEWKSAEEQGFEVYTAAEAAKKADIIMILINDEKQATMYKNDIEPNLEAGNMLMFAHGFNIHFGYIVPPKDVNVTMIAPKGPGHTVRSEYEEGKGVPCLVAVEQDATGKALDMALAYALAIGGARADVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 884 - DNA, 24 bp, Artificial Sequence
  K9_309I_111711r
ctttctcatagccttaatgtggac

SEQ ID NO: 885 - DNA, 24 bp, Artificial Sequence
  K9_309L_111711r
ctttctcatagcctttaagtggac

SEQ ID NO: 886 - DNA, 24 bp, Artificial Sequence
  K9_309Y_111711r
ctttctcatagccttatagtggac

SEQ ID NO: 887 - DNA, 24 bp, Artificial Sequence
  K9_309C_111711r
ctttctcatagccttacagtggac

SEQ ID NO: 888 - DNA, 24 bp, Artificial Sequence
  K9_309W_111711r
ctttctcatagccttccagtggac

SEQ ID NO: 889 - DNA, 24 bp, Artificial Sequence
  K9_309P_111711r
ctttctcatagcctttgggtggac

SEQ ID NO: 890 - DNA, 24 bp, Artificial Sequence
  K9_309H_111711r
ctttctcatagccttatggtggac

SEQ ID NO: 891 - DNA, 24 bp, Artificial Sequence
  K9_309Q_111711r
ctttctcatagccttttggtggac

SEQ ID NO: 892 - DNA, 24 bp, Artificial Sequence
  K9_309M_111711r
ctttctcatagccttcatgtggac

SEQ ID NO: 893 - DNA, 24 bp, Artificial Sequence
  K9_309N_111711r
ctttctcatagccttattgtggac

SEQ ID NO: 894 - DNA, 24 bp, Artificial Sequence
  K9_309V_111711r
ctttctcatagccttaacgtggac

SEQ ID NO: 895 - DNA, 24 bp, Artificial Sequence
  K9_309A_111711r
ctttctcatagccttagcgtggac

SEQ ID NO: 896 - DNA, 24 bp, Artificial Sequence
  K9_309D_111711r
ctttctcatagccttatcgtggac

SEQ ID NO: 897 - DNA, 24 bp, Artificial Sequence
  K9_309E_111711r
ctttctcatagccttttcgtggac

SEQ ID NO: 898 - DNA, 24 bp, Artificial Sequence
  K9_309G_111711r
ctttctcatagccttaccgtggac

SEQ ID NO: 899 - DNA, 24 bp, Artificial Sequence
  K9_309S_111711r
ctttctcatagccttagagtggac

SEQ ID NO: 900 - DNA, 24 bp, Artificial Sequence
  K9_309T_111711r
ctttctcatagccttagtgtggac

SEQ ID NO: 901 - DNA, 24 bp, Artificial Sequence
  K9_309R_111711r
ctttctcatagcctttctgtggac

SEQ ID NO: 902 - DNA, 24 bp, Artificial Sequence
  K9_309K_111711r
ctttctcatagccttcttgtggac

SEQ ID NO: 903 - DNA, 46 bp, Artificial Sequence
  Kshort1
aaaccggtttaaacagtatggctaagatttactaccaagaagactg

SEQ ID NO: 904 - DNA, 22 bp, Artificial Sequence
  YGrev
ttctgttttatcagaccgcttc

SEQ ID NO: 905 - DNA, 4978 bp, Artificial Sequence
  pBAD-ps-JEA1
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatgaaagttttctacgataaagactgcgacctgtcgatcatccaaggtaagaaagttgccatcatcggcttcggttcccagggccacgctcaagcactcaacctgaaggattccggcgtagacgtgactgttggcctgcctaaaggctttgctgatgtagccaaggctgaagcccacggctttaaagtgaccgacgttgctgcagccgttgccggtgccgacttggtcatgatcctgattccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggaggtattcctgacctgatcgcgatctaccaggacgtttccggcaacgccaagaacgtcgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaactaaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 906 - DNA, 36 bp, Artificial Sequence
  KPSH1
aaacagtatggctaagatttactaccaagaagactg

SEQ ID NO: 907 - DNA, 1017 bp, Artificial Sequence
  K9_Eliza_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaagatgcggaggaatggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 908 - DNA, 1017 bp, Artificial Sequence
  K9_Frank_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagctggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 909 - DNA, 1017 bp, Artificial Sequence
  K9_Grace_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcatcatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacataaccggtccaaagatcattactgaagataccaagaaggctatgaagaagattttgtctgacattcaagatggtacctttgccaaggacttcttggttgatatgtctgatgatggttcccaggtccacttcaaggctatgagaaagttggcctccgaacacccagctgaagttgtcggtgaagaaattagatccttgtactcctggtccgacgaagacaagttgattaacaactga

SEQ ID NO: 910 - DNA, 1017 bp, Artificial Sequence
  K9_Ingrid_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatttacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccagatccacttcaaggctatgagaaagttggcctccgaacacccagctgaagttgtcggtgaagaaattagatccttgtactcctggtccgacgaagacaagttgattaacaactga

SEQ ID NO: 911 - DNA, 1017 bp, Artificial Sequence
  K9_Jarvis_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtatcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 912 - DNA, 1017 bp, Artificial Sequence
  K9_Kelly_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtggggaggagtggaatagagctgaagaacaaggtttcgaagtctacaccgctgctgaagctgctaaaaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 913 - DNA, 1017 bp, Artificial Sequence
  9_Norman_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaatgtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 914 - DNA, 1017 bp, Artificial Sequence
  K9_Ophelia_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgcttcaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccatgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 915 - DNA, 1017 bp, Artificial Sequence
  K9_Pat_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattagaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 916 - DNA, 1017 bp, Artificial Sequence
  K9_Quentin
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatttacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 917 - DNA, 1017 bp, Artificial Sequence
  K9_Ralph_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttagaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 918 - DNA, 1017 bp, Artificial Sequence
  K9_Ursala
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgtggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtttgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 919 - DNA, 1017 bp, Artificial Sequence
  K9_Xavier_SH
atggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctgccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 920 - DNA, 44 bp, Artificial Sequence
  oMT93A
gatcccagatgaaatgcaggctgccatgtacaaaaacgacatcg

SEQ ID NO: 921 - DNA, 44 bp, Artificial Sequence
  oMT93Arev
cgatgtcgtttttgtacatggcagcctgcatttcatctgggatc

SEQ ID NO: 922 - DNA, 44 bp, Artificial Sequence
  oMT93I
gatcccagatgaaatgcaggctatcatgtacaaaaacgacatcg

SEQ ID NO: 923 - DNA, 44 bp, Artificial Sequence
  oMT93Irev
cgatgtcgtttttgtacatgatagcctgcatttcatctgggatc

SEQ ID NO: 924 - DNA, 22 bp, Artificial Sequence
  pHR81-F
acacccagtattttccctttcc

SEQ ID NO: 925 - DNA, 22 bp, Artificial Sequence
  pHR81- Rev
ctagtgtacagatgtatgtcgg

SEQ ID NO: 926 - protein, 570 aa, Artificial Sequence
  Lactococcus lactis DHAD
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 927 - protein, 343 aa, Artificial Sequence
  K9C4
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHAKAMRKLASEHPAEVVGEEIRSLYSWSDEDKLINN

SEQ ID NO: 928 - protein, 343 aa, Artificial Sequence
  K9C8
MEECKMAKIYYQEDCNLSLLDGKTIAVIGYGSQGHAHALNAKESGCNVIIGLFEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHTKAMRKLASEHPAEVVGEEIRSLYSWSDEDKLINN

SEQ ID NO: 929 - DNA, 4978 bp, Artificial Sequence
  K9SB2_SH in pBAD.KARI
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaagtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagag

SEQ ID NO: 930 - DNA, 12319 bp, Artificial Sequence
  pLH744
aggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgc

SEQ ID NO: 931 - DNA, 12304 bp, Artificial Sequence
  K9SB2_SH_DHAD
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 932 - DNA, 9612 bp, Artificial Sequence
  K9SB2_SH_81
catcatcacagtttaaacagtatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 933 - protein, 343 aa, Artificial Sequence
  882 C7
MEECKMAKIYYQEDCNLSLLDGKTIAVIGYGSQGHAHALNAKESGCNVIIGLYGGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 934 - protein, 343 aa, Artificial Sequence
  882 F9
MEECKMAKIYYQEDCNLSLLDGKTIAVIGYGSQGHAHALNAKESGCNVIIGLYEGAKEWKRAEEQGFEVYTAAEAAKKADIIMILINDEEQATMYKNDIEPNLEAGNMLMFAHGFNIHFGCIVPPKDVDVTMIAPKGPGHTVRSEYEEGKGVPCLVAVEHDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 935 - protein, 343 aa, Artificial Sequence
  882 G6
MEECKMAKIYYQEDCNLSLLDGKTIAVIGYGSQGHAHALNAKESGCNVIIGLYEAAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 936 - protein, 343 aa, Artificial Sequence
  882 G12
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTLRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILYDIQDGTFAKDFLVDMSDAGSQVHFKAMRKLASEHPAEVVGEEIRSLYSWSDEDKLINN

SEQ ID NO: 937 - protein, 343 aa, Artificial Sequence
  883 C4
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMVLAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 938 - protein, 343 aa, Artificial Sequence
  883 G9
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDMFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFMAMRKLASEHPAEVVGEEIRSLYSWSDEDKLINN

SEQ ID NO: 939 - protein, 571 aa, Artificial Sequence; identical to SEQ ID NO: 820
  Streptococcus mutans DHAD

SEQ ID NO: 940 - DNA, 1641 bp, Artificial Sequence
  M. caseolyticus KAD
atgaaacaacgtatcgggcaatacttgatcgatgccctacacgttaatggtgtcgataagatctttggagtcccaggtgatttcactttagcctttttggacgatatcataagacatgacaacgtggaatgggtgggaaatactaatgagttgaacgccgcttacgccgctgatggttacgctagagttaatggattagccgctgtatctaccacttttggggttggcgagttatctgctgtgaatggtattgctggaagttacgcagagcgtgttcctgtaatcaaaatctcaggcggtccttcatcagttgctcaacaagagggtagatatgtccaccattcattgggtgaaggaatctttgattcatattcaaagatgtacgctcacataaccgcaacaactacaatcttatccgttgacaacgcagtcgacgaaattgatagagttattcattgtgctttgaaggaaaagaggccagtgcatattcatttgcctattgacgtagccttaactgagattgaaatccctcatgcaccaaaagtttacacacacgaatcccagaacgtcgatgcttacattcaagctgttgagaaaaagttaatgtctgcaaaacaaccagtaatcatagcaggtcatgaaatcaattcattcaagttgcacgaacaactggaacagtttgtcaatcagacaaacatccctgttgcacaactttccttgggtaagtctgctttcaatgaagagaatgaacattaccttggtatctacgatggcaaaatcgcaaaggaaaatgtgagagagtacgtcgacaatgctgatgtcatattgaacataggtgccaaactgactgattctgctacagctggattttcctacaagttcgatacaaacaacataatctacattaaccataatgacttcaaagctgaagatgtgatttctgataatgtttcactgattgatcttgtgaatggcctgaattctattgactatagaaatgaaacacactacccatcttatcaaagatctgatatgaaatacgaattgaatgacgcaccacttacacaatctaactatttcaaaatgatgaacgcttttctagaaaaagatgacatcctactagctgaacaaggtacatcctttttcggcgcatatgacttatccctatacaagggaaatcagtttatcggtcagcctttatgggggtcaatagggtatacttttccatctttactaggaagtcaactagcagacatgcataggagaaacattttgcttataggcgatggtagtttacaacttactgttcaagccctaagtacaatgattagaaaggatatcaaaccaatcattttcgttatcaataacgacggttacaccgtcgaaagacttatccacggcatggaagagccatacaatgatatccaaatgtggaactacaagcaattgccagaagtatttggtggaaaagatactgtaaaagttcatgatgctaaaacctccaacgaactgaaaactgtaatggattctgttaaagcagacaaagatcacatgcatttcattgaagtgcatatggcagtagaggacgccccaaagaagttgattgatatagctaaagcctttagtgatgctaacaagtaa

SEQ ID NO: 941 - DNA, 1647 bp, Artificial Sequence
  L. grayi KAD
atgtacaccgtcggccaatacttagtagaccgcttagaagagatcggcatcgataaggtttttggtgtcccgggtgactacaacctgacctttttggactacatccagaaccacgaaggtctgagctggcaaggtaatacgaatgaactgaatgccgcgtacgcagctgatggctatgctcgtgaacgcggtgttagcgctttggtcacgaccttcggcgttggtgagctgtccgcaatcaatggcaccgcaggtagcttcgcggagcaagttccggtgattcatatcgtgggcagcccgaccatgaatgttcagagcaacaagaaactggttcatcacagcctgggtatgggcaactttcacaacttcagcgagatggcgaaagaagtcaccgccgcaaccacgatgctgacggaagagaatgcggcgtcggagattgatcgtgttctggaaaccgccctgctggagaaacgcccagtgtacatcaatctgccgatcgacattgctcacaaggcgatcgtcaagccggcgaaagccctgcaaaccgagaagagctctggcgagcgtgaggcacaactggcggagatcattctgagccatctggagaaggctgcacagccgattgtgattgcgggtcacgagatcgcgcgcttccagatccgtgagcgtttcgagaattggattaatcaaacgaaactgccggtgaccaatctggcctacggcaagggtagcttcaacgaagaaaacgagcatttcattggtacctattatcctgcatttagcgataagaacgtgctggactacgtggataactccgactttgtcctgcactttggtggtaaaatcattgataacagcacctccagcttctcccaaggcttcaaaaccgagaacaccctgactgcggcgaacgatatcattatgctgccggacggtagcacgtattctggtattagcctgaatggcctgctggccgagctggaaaaactgaatttcacgtttgccgacaccgcagcaaagcaggcggagttggcggtgtttgagccgcaggctgaaaccccgttgaaacaggaccgttttcaccaggcggtgatgaattttctgcaagctgacgatgtcctggttacggaacagggcacctcttcttttggcttgatgctggcgcctctgaaaaagggtatgaacttgatctcgcaaacgctgtggggtagcattggttacacgttgccggcgatgattggtagccaaattgcggcaccggagcgtcgtcatatcctgagcattggtgatggtagctttcagctgactgcgcaggaaatgagcaccattttccgtgagaaactgaccccagtcatcttcatcattaacaatgatggctataccgttgagcgtgcgatccatggcgaagatgaaagctataacgacattccgacgtggaacttgcaactggtggcggaaaccttcggtggtgacgccgaaaccgtcgacactcacaatgtgttcacggagactgatttcgccaacaccctggcggcaattgacgcgacgccgcagaaagcacacgttgtggaagttcacatggaacaaatggatatgccggagagcctgcgccagatcggtctggcactgtccaagcagaatagctaa

SEQ ID NO: 942 - protein, 491 aa, Artificial Sequence
  E. coli KARI
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 943 - protein, 338 aa, Artificial Sequence; identical to SEQ ID NO: 5
  Pseudomonas fluorescens KARI

SEQ ID NO: 944 - protein, 348 aa, Artificial Sequence; identical to SEQ ID NO: 812
  Achromobacter xylosoxidans ADH

SEQ ID NO: 945 - protein, 347 aa, Artificial Sequence
  B. indica ADH
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 946 - DNA, 1032 bp, Artificial Sequence
  K9_Eliza
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaagatgcggaggaatggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 947 - DNA, 1032 bp, Artificial Sequence
  K9_Frank
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagctggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 948 - DNA, 912 bp, Artificial Sequence
  K9_Grace
gctaaggaatccggttgtaacgttatcattggtttattcgaaggtgcggaggagtggaaaagagctgaagaacaaggtttcgaagtctacaccgctgctgaagctgctaagaaggctgacatcatcatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacataaccggtccaaagatcattactgaagataccaagaaggctatgaagaagattttgtctgacattcaagatggtacctttgccaaggacttcttggttgatatgtctgatgatggttcccaggtccacttcaaggctatgagaaagttggcctccgaacacccagctgaagttgtcggtgaagaaattagatccttgtactcctggtccgacgaagacaagttgattaacaactga

SEQ ID NO: 949 - DNA, 1032 bp, Artificial Sequence
  K9_Ingrid
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatttacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccagatccacttcaaggctatgagaaagttggcctccgaacacccagctgaagttgtcggtgaagaaattagatccttgtactcctggtccgacgaagacaagttgattaacaactga

SEQ ID NO: 950 - DNA, 1032 bp, Artificial Sequence
  K9_Jarvis
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtatcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 951 - DNA, 1032 bp, Artificial Sequence
  K9_Kelly
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtggggaggagtggaatagagctgaagaacaaggtttcgaagtctacaccgctgctgaagctgctaaaaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 952 - DNA, 1032 bp, Artificial Sequence
  K9_Norman
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaatgtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 953 - DNA, 1032 bp, Artificial Sequence
  K9_Ophelia
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgcttcaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccatgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 954 - DNA, 1032 bp, Artificial Sequence
  K9_Pat
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattagaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 955 - DNA, 1032 bp, Artificial Sequence
  K9_Quentin
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatttacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 956 - DNA, 1032 bp, Artificial Sequence
  K9_Ralph
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttagaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 957 - DNA, 1032 bp, Artificial Sequence
  K9_Sophia
atggaagaatgtaagatggctaatatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaatgcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacatcgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 958 - DNA, 1032 bp, Artificial Sequence
  K9_Tiberius
atggaagaatgtaagatggctaagatttactaccaagtagactgtaacttgtccttgttggatggtaagactattgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagccgctaagaaggctgacatcattatgatcttgatcccagatgaaaagcaggctaccatttacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacatcgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 959 - DNA, 1032 bp, Artificial Sequence
  K9_Ursala
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgtggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtttgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 960 - DNA, 1032 bp, Artificial Sequence
  K9_Victor
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgctcttgatcccagatgaaaagcaggctaccatgtacaaaaacgacatcgaaccaaacttggaagccggtaacatgttgatgttcgctcacggcttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 961 - DNA, 1032 bp, Artificial Sequence
  K9_Watson
atggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtgcaaaagagctgaagaacaaggcttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactga

SEQ ID NO: 962 - DNA, 978 bp, Lactobacillus plantarum
atggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaa

SEQ ID NO: 963 - DNA, 2367 bp, Lactobacillus plantarum
atgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataa

SEQ ID NO: 964 - DNA, 9613 bp, Artificial Sequence
  pHR81-ILV5p-K9SB
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttattcgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 965 - DNA, 12319 bp, Artificial Sequence
  pBP2090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

What is claimed is:

1. A method for producing isobutanol comprising:
   a) providing a recombinant yeast cell comprising:
      (i) an engineered isobutanol production pathway comprising a heterologous polypeptide having ketol-acid reductoisomerase (KARI) activity wherein said polypeptide having KARI activity has at least 99% identity to the amino acid sequence set forth in SEQ ID NO:196;
      (ii) a modification that eliminates expression or activity of a pyruvate decarboxylase polypeptide, wherein said modification is a deletion of an endogenous gene encoding said pyruvate decarboxylase polypeptide;
      (iii) a modification that eliminates expression or activity of an NAD-dependent glycerol-3-phosphate dehydrogenase polypeptide, wherein said modification is a deletion of an endogenous gene encoding said NAD-dependent glycerol-3-phosphate dehydrogenase polypeptide; and
      (iv) a modification that eliminates expression or activity of a polypeptide affecting Fe—S cluster biosynthesis in the yeast, wherein said modification is a deletion of an endogenous gene encoding said polypeptide affecting Fe—S cluster biosynthesis in the yeast; and
   b) contacting said recombinant yeast cell of a) with a carbon substrate under conditions whereby isobutanol is produced.

2. The method of claim 1, wherein said recombinant yeast cell further comprises a modification that eliminates expression or activity of an acetolactate reductase polypeptide in the yeast, wherein the modification is a deletion of an endogenous gene encoding said acetolactate reductase polypeptide.

3. The method of claim 1, wherein said recombinant yeast cell further comprises a modification that eliminates expression or activity of an aldehyde dehydrogenase polypeptide in the yeast, wherein said modification is a deletion of an endogenous gene encoding said aldehyde dehydrogenase polypeptide.

4. The method of claim 3, wherein said recombinant yeast cell further comprises a modification that eliminates the expression or activity of an acetolactate reductase polypeptide in the yeast, wherein the modification is a deletion of an endogenous gene encoding said acetolactate reductase polypeptide.

5. The method of claim 1, wherein the isobutanol is removed as it is produced.

6. A method for producing isobutanol comprising:
   a) providing a recombinant yeast cell comprising:
      (i) an engineered isobutanol production pathway comprising a heterologous polypeptide having ketol-acid reductoisomerase (KARI) activity wherein said polypeptide comprises the amino acid sequence set forth in SEQ ID NO: 196;
      (ii) a modification that eliminates expression or activity of a pyruvate decarboxylase polypeptide, wherein said modification is a deletion of an endogenous gene encoding said pyruvate decarboxylase polypeptide;
      (iii) a modification that eliminates expression or activity of an NAD-dependent glycerol-3-phosphate dehydrogenase polypeptide, wherein said modification is a deletion of an endogenous gene encoding said NAD-dependent glycerol-3-phosphate dehydrogenase polypeptide; and
      (iv) a modification that eliminates expression or activity of a polypeptide affecting Fe—S cluster biosynthesis in the yeast, wherein said modification is a deletion of an endogenous gene encoding said polypeptide affecting Fe—S cluster biosynthesis in the yeast; and
   b) contacting said recombinant yeast cell of a) with a carbon substrate under conditions whereby isobutanol is produced.

7. The method of claim 6, wherein said recombinant yeast cell further comprises a modification that eliminates expression or activity of an acetolactate reductase polypeptide in the yeast, wherein the modification is a deletion of an endogenous gene encoding said acetolactate reductase polypeptide.

8. The method of claim 6, wherein said recombinant yeast cell further comprises a modification that eliminates expression or activity of an aldehyde dehydrogenase polypeptide in the yeast, wherein said modification is a deletion of an endogenous gene encoding said aldehyde dehydrogenase polypeptide.

9. The method of claim 8, wherein said recombinant yeast cell further comprises a modification that eliminates the expression or activity of an acetolactate reductase polypeptide in the yeast, wherein the modification is a deletion of an endogenous gene encoding said acetolactate reductase polypeptide.

10. The method of claim 6, wherein the isobutanol is removed as it is produced.

* * * * *